(12) United States Patent
Liu et al.

(10) Patent No.: US 9,181,535 B2
(45) Date of Patent: Nov. 10, 2015

(54) TRANSCRIPTION ACTIVATOR-LIKE EFFECTOR NUCLEASES (TALENS)

(71) Applicant: The Chinese University of Hong Kong, Shatin, New Territories (CN)

(72) Inventors: Yun Liu, Shatin (HK); Christopher H. K. Cheng, Ma On Shan (HK)

(73) Assignee: THE CHINESE UNIVERSITY OF HONG KONG, Shatin, New Territories, Hong Kong (CN)

( * ) Notice: Subject to any disclaimer, the term of this patent is extended or adjusted under 35 U.S.C. 154(b) by 0 days.

(21) Appl. No.: 14/035,774

(22) Filed: Sep. 24, 2013

(65) Prior Publication Data

US 2014/0087426 A1 Mar. 27, 2014

Related U.S. Application Data

(60) Provisional application No. 61/704,917, filed on Sep. 24, 2012.

(51) Int. Cl.
*C12N 9/22* (2006.01)
*C12N 15/90* (2006.01)
*C12N 15/85* (2006.01)

(52) U.S. Cl.
CPC *C12N 9/22* (2013.01); *C12N 15/85* (2013.01); *C12N 15/902* (2013.01)

(58) Field of Classification Search
None
See application file for complete search history.

(56) References Cited

PUBLICATIONS

Chica et al. Curr Opin Biotechnol. Aug. 2005;16(4):378-84.*
Sen et al. Appl Biochem Biotechnol. Dec. 2007;143(3):212-23.*
Boch et al., "Breaking the Code of DNA Binding Specificity of TAL-Type III Effectors", Science, vol. 326, pp. 1509-1512 (2009).
Bogdanove et al., TAL Effectors: Customizable Proteins for DNA Targeting, Science, vol. 333, pp. 1843-1846 (2011).
Cade et al., "Highly efficient generation of heritable zebrafish gene mutations using homo- and heterodimeric TALENs", *Nucleic Acids Research*, vol. 40, pp. 8001-8010 (2012).
Cermak et al., "Efficient design and assembly of custom TALEN and other TAL effector-based constructs for DNA targeting", *Nucleic Acids Research*, vol. 39, No. 17, e82 (2011).
Christian et al., "Targeting DNA Double-Strand Breaks with TAL Effector Nucleases", *Genetics*, vol. 186, pp. 757-761 (2010).
Deng et al., "Structural Basis for Sequence-Specific Recognition of DNA by TAL Effectors", *Science*, vol. 335, pp. 720-723 (2012).
Doyon et al., "Enhancing zinc-finger-nuclease activity with improved obligate heterodimeric architectures", *Nature Methods*, vol. 8, No. 1, pp. 74-79 (2011).
Hockemeyer et al., "Genetic engineering of human ES and iPS cells using TALE Nucleases", *Nat. Biotechnol.*, vol. 29, p. 731-734 (2011).
Huang et al., "Heritable gene targeting in zebrafish using customized TALENs", *Nat Biotechnol.*, vol. 29, pp. 699-700 (2011).
Mahfouz et al., "De novo-engineered transcription activator-like effector (TALE) hybrid nuclease with novel DNA binding specificity creates double-strand breaks", *PNAS*, vol. 108, pp. 2623-2628 (2011).
Mak et al., "The crystal structure of TAL effector PthXo1 bound to its DNA Target", *Science*, pp. 716-719 (2012).
Miller et al., "A TALE nuclease architecture for efficient genome editing", *Nat. Biotechnol.*, vol. 29, pp. 143-148 (2011).
Moscou et al., "A Simple Cipher Governs DNA Recognition by TAL Effectors", *Science*, vol. 326, pp. 1501 (2009).
Mussolino et al., "TALE nucleases: tailored genome engineering made easy", *Curr Opin Biotechnol.*, vol. 23, pp. 644-650 (2012).
Sander et al., "Selection-Free Zinc-Finger Nuclease Engineering by Context-Dependent Assembly (CoDA)", *Nat. Methods*, vol. 8, pp. 67-69 (2011).
Scholze et al., "TAL effector-DNA specificity", *Virulence*, vol. 1, pp. 428-432 (2010).
Tesson et al., "Knockout rats generated by embryo microinjection of TALENs", *Nat. Biotechnol.*, vol. 29, pp. 695-696 (2011).
Wood et al., "Targeted Genome Editing Across Species Using ZFNs and TALENs", *Science*, vol. 33, pp. 307 (2011).
Young et al., "Efficient targeted gene disruption in the soma and germ line of the frog *Xenopus tropicalis* using engineered zinc-finger nucleases", *PNAS*, vol. 108, pp. 7052-7057 (2011).

* cited by examiner

*Primary Examiner* — Christian Fronda
(74) *Attorney, Agent, or Firm* — Kilpatrick Townsend & Stockton LLP

(57) ABSTRACT

This application provides transcription activator-like effector nucleases (TALENs), polynucleotide sequences encoding the TALENs, expression cassettes for producing TALENs to target cleavage of nucleic acids, and methods of producing and using the TALENs.

11 Claims, 41 Drawing Sheets pTAL1:
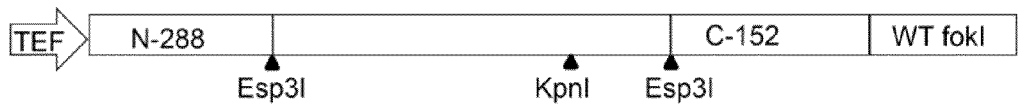
pCS2-Flag-TTGZFP-FokI-DD:
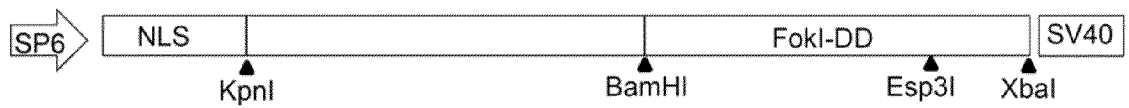
1. Amplification of △N152-Esp3I-C63 fragment from vector pTAL1;
2. Mutation of KpnI site in the △N152-Esp3I-C63 fragment;
3. Mutation of Esp3I site in the pCS2-Flag-TTGZFP-FokI-DD;
4. Insertion of the △N152-Esp3I-C63 fragment into the pCS2-Flag-TTGZFP-FokI-DD;
5. Replacement of DD fokI by DLE or KKR fokI.
pCS2-TALENs-DLE/KKR:
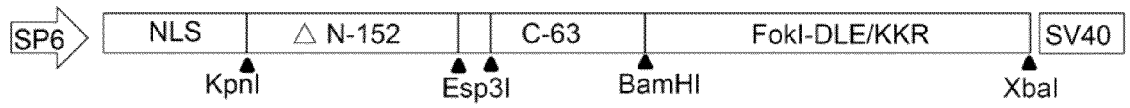
*Fig. 1* a.
Gria3a: mutations in 49 of 55 sequences (~89.1%)
```
AGTCGTCCAATAGCTTCTCAGTCACGCACGCCTGTGAGTTTCTGCTCTTTAT WT
AGTCGTCCAATAGCTTCTCAGTCtcagtCGCCTGTGAGTTTCTGCTCTTTAT
AGTCGTCCAATAGCTTCTCAGTCACGCA--CCTGTGAGTTTCTGCTCTTTAT
AGTCGTCCAATAGCTTCTCA--atagcttcCCTGTGAGTTTCTGCTCTTTAT
AGTCGTCCAATAGCTTCTCAGTCAC---CGCCTGTGAGTTTCTGCTCTTTAT
AGTCGTCCAATAGCTTCTCAGTttttgcag---GTGAGTTTCTGCTCTTTAT
AGTCGTCCAATAGCTTCTCAGTCACcctgggat----TTTCTGCTCTTTAT
AGTCGTCCAATAGCTTCTCAGTCACG----CCTGTGAGTTTCTGCTCTTTAT X4
AGTCGTCCAATAGCTTCTCAGTCA----gtCCTGTGAGTTTCTGCTCTTTAT
AGTCGTCCAATAGCTTCTCAG----acatgatTGTGAGTTTCTGCTCTTTAT
AGTCGTCCAATAGCTTCTCACTCA-----GCCTGTGAGTTTCTGCTCTTTAT X3
AGTCGTCCAATAGCTTCTCAGTC------GCCTGTGAGTTTCTGCTCTTTAT X5
AGTCGTCCAATAGCTTCTCAGTCACG------TGTGAGTTTCTGCTCTTTAT X3
AGTCGTCCAATAGCTTCTCAGTCAC------CTGTGAGTTTCTGCTCTTTAT X4
AGTCGTCCAATAGCTTCTCAGTCA-------gttgaAGTTTCTGCTCTTTAT
AGTCGTCCAATAGCTTCTCAGTCAC-------TGTGAGTTTCTGCTCTTTAT
AGTCGTCCAATAGCTTCTCAGTCAC--------GTGAGTTTCTGCTCTTTAT X7
AGTCGCCCAATAGCTTCTCAGTC---------TGTGAGTTTCTGCTCTTTAT
AGTCGTCCAATAGCTTCTCAGTC--------CTGTGAGTTTCTGCTCTTTAT X2
AGTCGTCCAATAGCTTCTCAG---------CCTGTGAGTTTCTGCTCTTTAT X2
AGTCGTCCAATAGCTTCTCAGTC---------TGTGAGTTTCTGCTCTTTAT X2
AGTCGTCCAATAGCTTCTC----------GCCTGTGAGTTTCTGCTCTTTAT X2
AGTCGTCCAATAGCTTCTCAGT-----------GTGAGTTTCTGCTCTTTAT
AGTCGTCCAATAGCTTCTCAGTC----------------------------- Lost 38bp
-----------------------CACGCACGCCTGTGAGTTTCTGCTCTTTAT Lost 40bp
AGTCGTCCAATAGCTTCTCAGTCAgcttctCGCCTGTGAGTTTCTGCTCTTTAT
```
b.
Tnikb: mutations in 18 of 39 sequences (~46.2%)
```
CTGTTATTTTCTCCCCTAAGGATCCTGCGGGCATTTTTGAGCTGGTGGAG
CTGTTATTTTCTCCCCTAAGGcatctcCGGGCATTTTTGAGCTGGTGGAG
CTGTTATTTTCTCCCCTAAGG------CGGGCATTTTTGAGCTGGTGGAG
CTGTTATTTTCTCCCCTAAGGA-------GGCATTTTTGAGCTGGTGGAG X2
CTGTTATTTTCTCCCCTAAGGAT-------CATTTTTGAGCTGGTGGAG X2
CTGTTATTTTCTCCCCTAAGGA--------GCATTTTTGAGCTGGTGGAG
CTGTTATTTTCTCCCT---------GCGGGCATTTTTGATCTGGTGGAG X2
CTGTTATTTTCTCCCCTAAGG---------GCATTTTTGAGCTGGTGGAG X3
CTGTTATTTTCTCCCCTAAGG----------CATTTTTGAGCTGGTGGAG
CTGTTATTTTCTCCCCTAAGG-----------ATTTTTGAGCTGGTGGAG X2
CTGTTATTTTCTCCCC------------GGGCATTTTTGAGCTGGTGGAG
CTGTTATTTTCTCCCCTAAGGATtttaaggaGCGGGCATTTTTGAGCTGGTGGAG
CTGTTATTTTCTCCCCTAAGGAacattacctttttGGGCATTTTTGAGCTGGTGGAG
```

*Fig. 3* d.
Kiss1: mutations in 32 of 40 sequences (~80.0%)
GTACACACAAACCCCTCTGGGCATTTTCAGTATTACTTAGAAGGTAAGTTCAC
GTACACACAAACCCCTCTGGGCATTT-CAGTATTACTTAGAAGGTAAGTTCAC X4
GTACACACAAACCCCTCTGGGCATTTT-AGTATTACTTAGAAGGTAAGTTCAC
GTACACACAAACCCCTCTGGG-tacctaAGTATTACTTAGAAGGTAAGTTCAC
GTACACACAAACCCCTCTGGGCAT---CAGTATTACTTAGAAGGTAAGTTCAC
GTACACACAAACCCCTCTGGGCA----aaGTATTACTTAGAAGGTAAGTTCAC
GTACACACAAACCCCTCTGGG----tctgGTATTACTTAGAAGGTAAGTTCAC
GTACACACAAACCCCTCTGGGCATT----GTATTACTTAGAAGGTAAGTTCAC
GTACACACAAACCCCTCTGGGCAT-----GTATTACTTAGAAGGTAAGTTCAC X2
GTACACACAAACCCCTCTGGGCAT-------ATTACTTAGAAGGTAAGTTCAC X5
GTACACACAAACCCCTCTGGGCATTTT-------ACTTAGAAGGTAAGTTCAC X2
GTACACACAAACCCCTCTGGGCATT--------acCTTAGAAGGTAAGTTCAC
GTACACACAAACCCCTCT--------aaagggttctTTAGAAGGTAAGTTCAC
GTACACACAAACCCCTCTGGGCATT---------ACTTAGAAGGTAAGTTCAC X4
GTACACACAAACCCCTCTGGGC-----------ACTTAGAAGGTAAGTTCAC
GTACACACAAACCCCTCTGGGCATTTTtCAGTATTACTTAGAAGGTAAGTTCAC X2
GTACACACAAACCCCTCTGGGCATTactgggGTATTACTTAGAAGGTAAGTTCAC
GTACACACAAACCCCTCTGGGCATTagtattcTCAGTATTACTTAGAAGGTAAGTTCAC
GTACACACAAACCCCTCTGGGCATTactatcctatggGTATTACTTAGAAGGTAAGTTCAC
GTACACACAAACCCCTCTGGGCATTaatacctcctctggGTATTACTTAGAAGGTAAGTTCAC
e.
Kiss2: mutations in 67 of 67 sequences (~100%)
CTGATTCTCTTCATGTCTGCAATGGTCAGTCAGTCTACAGCTATGAGAGCAATAC
CTGATTCTCTTCATGTCTGCAATG------catTCTACAGCTATGAAAGCAATAC
CTGATTCTCTTCATGTCTGCAAT-------CAGTCTACAGCTATGAGAGCAATAC
CTGATTCTCTTCATGTCTGCAATGGTCAG-------ACAGCTATGAGAGCAATAC
CTGATTCTCTTCATGTCTGCAATGGTC--------TACAGCTATGAGAGCAATAC X33
CTGATTCTCTTCATGTCTGCAATagtc--------TACAGCTATGAGAGCAATAC
CTGATTCTCTTCATGTCTGCAATGGTCAG--------CAGCTATGAGAGCAATAC
CTGATTCTCTTCATGTCTGCA--------gtgGTCTACAGCTATGAGAGCAATAC
CTGATTCTCTTCATGTCTGCAA--------CAGTCTACAGCTATGAGAGCAATAC
CTGATTCTCTTCATGTCTGCAATG---------TCTACAGCTATGAGAGCAATAC X2
CTGATTCTCTTCATGTCTGCA---------CAGTCTACAGCTATGAGAGCAATAC
CTGATTCTCTTCATGTCTGCAATGt---------CTACAGCTATGAGAGCAATAC X2
CTGATTCTCTTCATGTCTGCAATGG---------CTACAGCTATGAGAGCAATAC
CTGATTCTCTTCATGTCTGC-----------AGTCTACAGCTATGAGAGCAATAC
CTGATTCTCTTCATGTCTGCAATGGTCAG----------CTATGAGAGCAATAC
CTGATTCTCTTCATGTCTGCA----------GTCTACAGCTATGAGAGCAATAC X5
CTGATTCTCTTCATGTCT-----------------ACAGCTATGAGAGCAATAC X5
CTGATTCTCTTCATGTCTGCAATGGTC------------------tGCAATAC X2
CTGATTCTCTTCATGTCT--------------------GCTATGAGAGCAATAC
-------------------------------ctgattctCAGCTATGAGAGCAATAC
CTGATTCTCTTCATGTCTGCAATGGTagtCAGTCAGTCTACAGCTATGAGAGCAATAC
CTGATTCTCTTCATGTCTGCAATGGTCActtttgcatTCTACAGCTACAGCTATGAGA
GCAATAC
CTGATTCTCTTCATGTCTGCAATGGTCtacagaaaaaagtctacaaaagtctgcaaAG
TCTACAGCTATGAGAGCAATAC
CTGATTCTCTTCATGTCTGCAATGGTatcagatcaaaatcagtcaatcaatcaaaatc
AGTCTACAGCTATGAGAGCAATAC X2

*Fig. 4 (cont'd)* f.
GnRH3: Mutations in 6 of 33 sequences (~18.1%)
GTGTTTTAGTTTTAGCATGGAGTGGAAAGGAAGGTTGCTGGTCCAGTTGTTGCTGTTAG
GTGTTTTAGTTTTAGCATGGAGTGGAAAGG----TTGCTGGTCCAGTTGTTGCTGTTAG
GTGTTTTAGTTTTAGCATGGAGTGG---------------TCCAGTTGTTGCTGTTAG
------------------------------------------GTCCAGTTGTTGCTGTTAG lost 49 bp
GTGTTTTAGTTTTAGCATGGAGTGGAAAGGtccagctgtTGGTCCAGTTGTTGCTGTTAG
GTGTTTTAGTTTTAGCATGGAGTGGAAAGGAAaGGTTGCTGGTCCAGTTGTTGCTGTTAG
GTGTTTTAGTTTTAGCATGGAGTGGAAAGGAAGGTTtgtTGGTCCAGTTGTTGCTGTTAG g.
Spexin: Mutations in 33 of 36 sequences (~91.7%)
ATTTGTGTCCCATTCCTGGAGCGCACCCAAGGTAATGTCATGCAATGTTAT
ATTTGTGTCCCATTCCTGGAGCGC---CAAGGTAATGTCATGCAATGTTAT X2
ATTTGTGTCCCATTCCTGGAGCGCA----AGGTAATGTCATGCAATGTTAT
ATTTGTGTCCCATTCCTGGAGCG----gtAGGTAATGTCATGCAATGTTAT
ATTTGTGTCCCATTCCTGGAGCGC----catGTAATGTCATGCAATGTTAT
ATTTGTGTCCCATTCC----cggagcgCAAGGTAATGTCATGCAATGTTAT
ATTTGTGTCCCATTCCTGGAGC-----CAAGGTAATGTCATGCAATGTTAT X3
ATTTGTGTCCCATTCCTGGAGCGt-----AGGTAATGTCATGCAATGTTAT
ATTTGTGTCCCATTCCTGGAGC------AAGGTAATGTCATGCAATGTTAT X5
ATTTGTGTCCCATTCCTGGAGCG-------aaTAATGTCATGCAATGTTAT
ATTTGTGTCCCATTCCTGGAGCG--------GTAATGTCATGCAATGTTAT
ATTTGTGTCCCATTCCTGGAGCG---------TAATGTCATGCAATGTTAT X2
ATTTGTGTCCCATTCCTGGAGCGt---------AATGTCATGCAATGTTAT X2
ATTTGTGTCCCATTCCTGGAG----------GTAATGTCATGCAATGTTAT X3
ATTTGTGTCCCATTCC-----------CAAGGTAATGCCTTGCAATGTTAT
ATTTGTGTCCCATTCCTGGAG----------TAATGTCATGCAATGTTAT
ATTTGTGTCCCATTCC-----------AAGGTAATGTCATGCAATGTTAT X2
ATTTGTGTCCCATTCCTGGt-------------AATGTCATGCAATGTTAT
ATTTGTGTCCCATTCCTGGAGCGC-------------CATGCAATGTTAT
ATTTGTGTCCCATTCCTGGAGCG-------------------------- lost 101bp
ATTTGTGTCCCATTCCTGGAGCGCacccACCCAAGGTAATGTCATGCAATGTTAT
ATTTGTGTCCCATTCCTgtgtcccattccatCACCCAAGGTAATGTCATGCAATGTTAT

*Fig. 4 (cont'd)* a. Mir-214: mutations in 25 of 47 sequences (~53%)

```
GTGCAGAACTTCCTGCACCTGTACAGCAGGCACAGACAGGCAGACAGATGGCAG WT
GTGCAGAACTTCCTGCACCTGTACA--------CAGACAGGCAGACAGATGGCAG
GTGCAGAACTTCCTGCACCTGTACA---------GACAGGCAGACAGATGGCAG X14
GTGCAGAACTTCCTGC----------gcctGCACAGACAGGCAGACAGATGGCAG
GTGCAGAACTTCCTGCACCTGTACAG----------accGGCAGACAGATGGCAG
GTGCAGAACTTCCTGCACCTGTACAG----------attGCAGACAGATGGCAG
GTGCAGAACTTCCTGCACCTGTACAG--------------GCAGACAGATGGCAG
GTGCAGAACTTCC---------------AGGCACAGACAGGCAGACAGATGGCAG
GTGCAGAACTTCCTGCACCTGTACAG------------------ACAGATGGCAG
GTGCAGAACTTCCTGCACCT------------------tcctgcACAGATGGCAG
GTGCAGAACTTCCTGCACCT------------------gtaCAGACAGATGGCAG
GTGCAGAACTTCCTGCACCTGT------------------------ACAGATGGCAG
GTGCAGAACTTCCTGCACCTGT------------------------CAGATGGCAG
``` b.

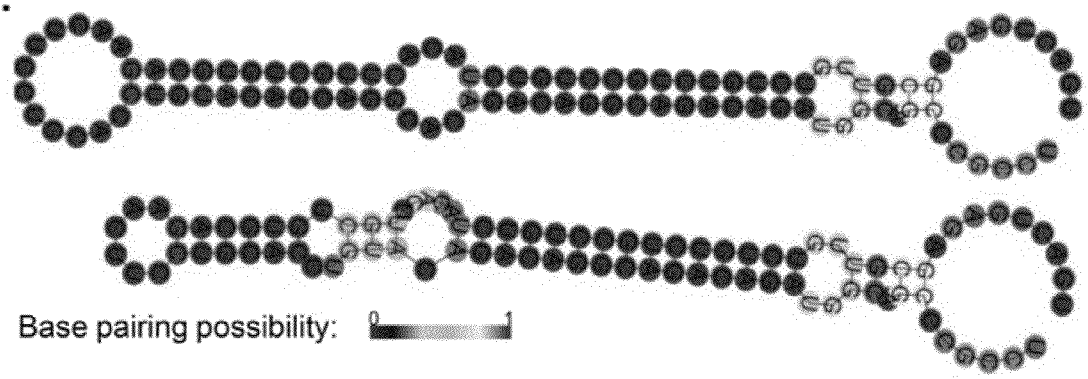

Base pairing possibility: 0 ─── 1

*Fig. 5* a.
Mir-451: mutations in 2 of 47 sequences (~4.3%)
ATCGCTGTGACAGAGAGAGGCGGCGAAACCGTTACCATTACTGAGTTTAGTAATGGTAA
ATCGCTGTGACAGAGAGAGGC--------------------TGAGTTTAGTAATGGTAA
ATCGCTGTGACAGAGAGAGGCG---------------------AGTTTAGTAATGGTAA b.
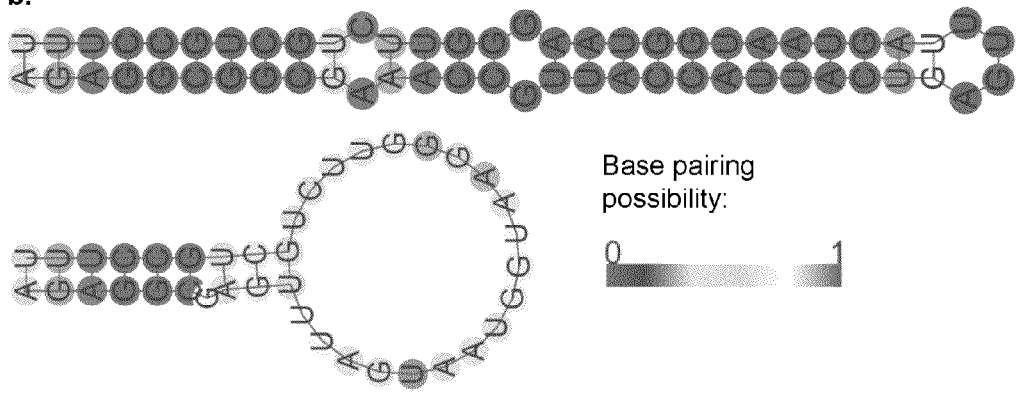

Base pairing possibility:

0 ▬▬▬▬ 1 c.
Mir-1-1: mutations in 64 of 66 sequences (~97.0%)
ATATGAACAAGAGCAGCTATGGAATGTAAAGAAGTATGTATCCCAGGTGAG
ATATGAACAAGAGCAGCTATGGAATGTAA-GAAGTATGTATCCCAGGTGAG
ATATGAACAAGAGCAGCTATGC----TAAAGAAGTATGTATCCCAGGTGAG
ATATGAACAAGAGCAGCTATGGAA----AAGAAGTATGTATCCCAGGTGAG  X2
ATATGAACAAGAGCAGCTATGG-----aagaagaTATGTATCCCAGGTGAG
ATATGAACAAGAGCAGCTATGGAA------GAAGTATGTATCCCAGGTGAG  X13
ATATGAACAAGAGCAGCTATG------AAAGAAGTATGTATCCCAGGTGAG  X2
ATATGAACAAGAGCAGCTATGGA------tGAAGTATGTATCCCAGGTGAG
ATATGAACAAGAGCAGCTATGGA------AGAAGTATGAATCCCAGGTGAG
ATATGAACAAGAGCAGCTAT-------AAAGAAGTATGTATCCCAGGTGAG  X2
ATATGAACAAGAGCAGCTATGG-------AGAAGTATGTATCCCAGGTGAG  X2
ATATGAACAAGAGCAGCTATG-------AAGAAGTATGTATCCCAGGTGAG
ATATGAACAAGAGCAGCTAT--------AAGAAGTATGTATCCCAGGTGAG
ATATGAACAAGAGCAGCTAT---------AGAAGTATGTATCCCAGGTGAG
ATATGAACAAGAGCAGCTATGGA--------gAGTATGTATCCCAGGTGAG
ATATGAACAAGAGCAGCTATGGA---------AGTATGTATCCCAGGTGAG  X19
ATATGAACAAGAGCAGCTATGGA----------GTATGTATCCCAGGTGAG  X2
ATATGAACAAGAGCAGC---------AAAGAAGTATGTATCCCAGGTGAG
ATATGAACAAGAGCAG---------TAAAGAAGTATGTATCCCAGGTGAG
ATATGAACAAGAGCAGCTATG---------------TATCCCAGGTGAG
ATATGAACAAGA-------------------actatgttTCCCAGGTGAG
ATATG--------------------TAAAGAAGTATGTATCCCAGGTGAG
ATATGAACAAGAGCAGCTATGGAA------------------------ lost 101bp
----------------------------GAAGTATGTATCCCAGGTGAG lost 26bp
ATATGAACAAGAGCAGCTATGGAAgtatgtAAGAAGTATGTATCCCAGGTGAG
ATATGAACAAGAGCAGCTATGagaagtagaacctAAGAAGTATGTATCCCAGGTGAG
ATATGAACAAGAGCAGCTATGGAAagtatgaaaaGTAAAGAAGTATGTATCCCAGGTGAG
ATATGAACAAGAGCAGCTATGGAAgtatgtatcccaggtgaGAAGTATGTATCCCAGGTGAG
ATATGAACAAGAGCAGCTATGGAtgtatgtagtatgtattgtatggatgtAGAAGTATGTATCCCAGGTGAG
ATATGAACAAGAGCAGCTAgtatgaagtatgtataattggagcagctagtAGAAGTATGTATCCCAGGTGAG

*Fig. 6* d.

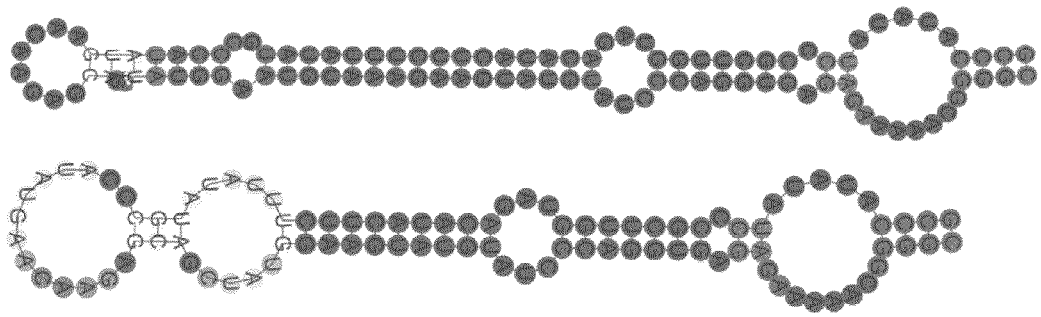

Base pairing possibility: 0 ———— 1 e.
Mir-1-2: mutations in 34 of 41 seqence (~83.0%)
ATATGAACATATAAAAGCTATGGAATGTAAAGAAGTATGTATTCTTGGTCAG
ATATGAACATATAAAAGCTATGGAATGTAA-GAAGTATGTATTCTTGGTCAG
ATATGAACATATAAAAGCTATGGA--GTAAAGAAGTATGTATTCTTGGTCAG
ATATGAACATATAAAAGCTATGGAAg----AGAAGTATGTATTCTTGGTCAG
ATATGAACATATAAAAGCTATGGA-----atGAAGTATGTATTCTTGGTCAG
ATATGAACATATAAAAGCTATGG-----AAAGAAGTATGTATTCTTGGTCAG X5
ATATGAACATATAAAAGCTATGGA-----AAGAAGTATGTATTCTTGGTCAG
ATATGAACATATAAAAGCTATG-----aaagGAAGTATGTATTCTTGGTCAG
ATATGAACATATAAAAGCTATGGA------AGAAGTATGTATTCTTGGTCAG X7
ATATGAACATATAAAAGCTATGGAATG--------TATGTATTCTTGGTCAG
ATATGAACATATAAAAGCTATGGAA---------GTATGTATTCTTGGTCAG X5
ATATGAACATATAAAAGCTATGGAAGttt---------GTATTCTTGGTCAG
ATATGAACATATAAAAGCTATGGAAG---------TATGTATTCTTGGTCAG
ATATGAACATATAAAAGCTATG-----------------TATTCTTGGTCAG
ATATGAACATATAAA------------------GTATGTATTCTTGGTCAG
ATATGAACATATAAAAGCTATGGAAgccgttgttaaagAAGAAGTATGTATTCTTGGTCAG
ATATGAACATATAAAAGCTATGGAgcatatggaacataTAAAGAAGTATGTATTCTTGGTCAG
ATATGAACATATAAAAGCTATGGAgcatatggaacataTAAAGAAGTATGTATTCTTGGTCAG
ATATGAACATATAAAAGCTATGGAAgtatccagcttctggaaTGTAAAGAAGTATGTATTCTTGGTCAG
ATATGAACATATAAAAGCTATGGAATGTAtgtattcttggaaatggaAAGAAGTATGTATTCTTGGTCAG
ATATGAACATATAAAAGCTATGGAATagaagtatgtatgtatgtatgtatgtatgtatgtatgtat
gtatgtAAGAAGTATGTATTCTTGGTCAG

*Fig. 6 (cont'd)* f.

Base pairing
possibility: 0 ——— 1

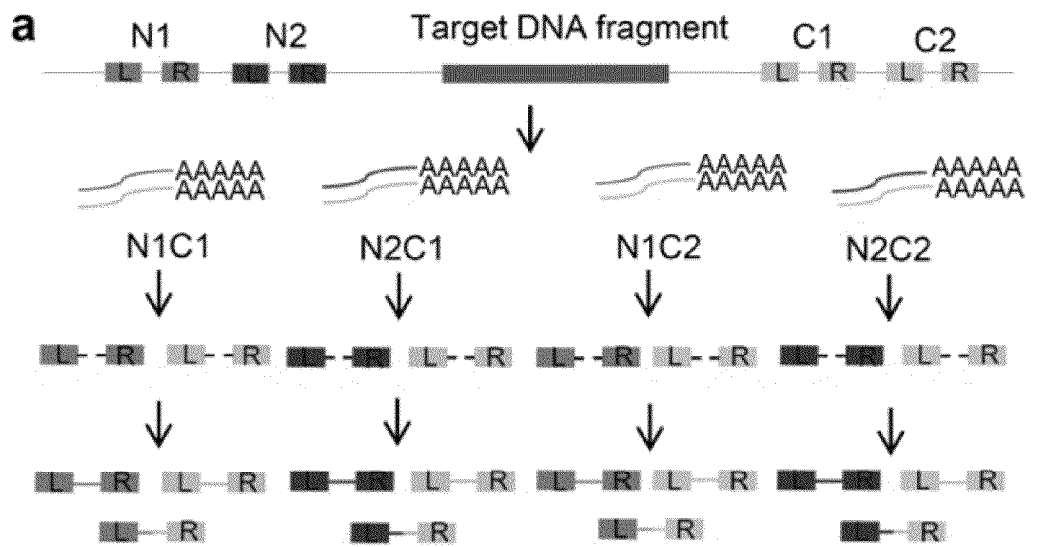
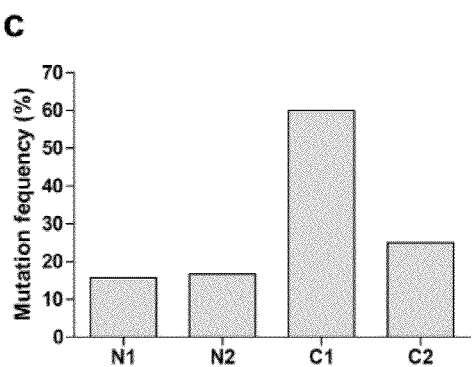 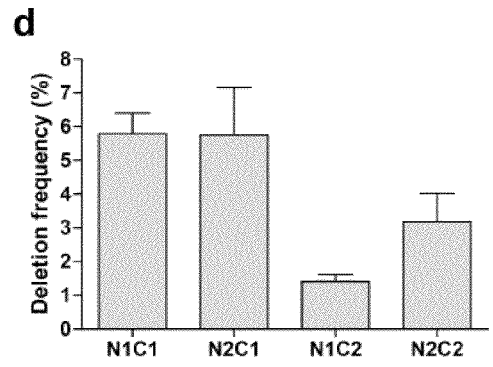
*Fig. 7*

Mir-17-92N1: mutations in 3 of 19 sequences (~15.8%)
GTCAACCCCATGTACCATCAATATCTATTGTATTTGAATAATTCTACAGGTAA
GTCAACCCCATGTACCATCAATAT-----GTATTTGAATAATTCTACAGGTAA
GTCAACCCCATGTACCATCAATAT---------TTGAATAATTCTACAGGTAA
GTCAACCCCATGTACCATCAATATCTcaattgtattcaaATTGTATTTGAATAATTCTACAGGTAA
Mir-17-92N2: mutations in 3 of 18 sequences (~16.7%)
CTCAAATATTTCTCCCCTTCCCCCTCTCAGAATTCCCAGGAAAGATGGGAGTAG
CTCAAATATTTCTCCCCTTCCCCCTC------TTCCCAGGAAAGATGGGAGTAG
CTCAAATATTTCTCCCCTTCCCCC-------ATTCCCAGGAAAGATGGGAGTAG
CTCAAATATTTCTCCCCTTCCC--------------AGGAAAGATGGGAGTAG
Mir-17-92C1: mutations in 12 of 20 sequences (~60.0%)
TTATTATCTTAACACTGTAATTTTTACACCATGCAAGGCATGATTAACATTTAGAC
TTATTATCTTAACACTGTAATTTTTACAC-ATGCAAGGCATGATTAACATTTAGAC
TTATTATCTTAACACTGTAATTTTT----CATGCAAGGCATGATTAACATTTAGAC
TTATTGTCTTAACACTGTAATT----gcaaATGCAAGGCATGATTAACATTTAGAC
TTATTATCTTAACACTGTAATTTTT-------GCAAGGCATGATTAACATTTAGAC
TTATTATCTTAACACTGTAATTTTTA-------CAAGGCATGATTAACATTTAGAC X3
TTATTATCTTAACACTGTAATT-----------CAAGGCATGATTAACATTTAGAC
TTATTATCTTA----------------------gGGCATGATTAACATTTAGAC
TTATTATCTTAACACTGTAATTTTTACAaattatgaATGCAAGGCATGATTAACATTTAGAC
TTATTATCTTAACACTGTAATTTTTtctaaatgttaatCATGCAAGGCATGATTAACATTTAGAC
TTATTATCTTAACACTGTAATTTTTACaaggcaaggcatgcaaggcattGCAAGGCATGATTAACATTTAGAC
Mir-17-92C2: mutations in 5 of 20 sequences (~25.0%)
CTCTTCAGATTTATCAAATCCAATTATAAAAATGCAGAGTAAGCCGAGTAATCTAG
CTCTTCAGATTTATCAAATCCAATTATAAAA-TGCAGAGTAAGCCGAGTAATCTAG
CTCTTCAGATTTATCAAATCCAATcc-AAAAATGCAGAGTAAGCCGAGTAATCTAG
CTCTTCAGATTTATCAAATCCAATTAT------GCAGAGTAAGCCGAGTAATCTAG X3

Mir-17-92N1C2

TCAACCCCATGTACCATCaatatcaGAGTAAGCCGAGTAATCTA
TCAACCCCATGTACCATCaataatgcaGAGTAAGCCGAGTAATCTA
TCAACCCCATGTACCATCaatataatgcaGAGTAAGCCGAGTAATCTA
TCAACCCCATGTACCATCaatacaatgcaGAGTAAGCCGAGTAATCTA
TCAACCCCATGTACCATCaatatctaaatgcaGAGTAAGCCGAGTAATCTA
TCAACCCCATGTACCATCaatatctaaaaatgcaGAGTAAGCCGAGTAATCTA
TCAACCCCATGTCCCATCcatatccaatcataataatgcaGAGTAAGCCGAGTAATCTA
TCAACCCCATGTACCATCaataatcaaatacaataatgcaGAGTAAGCCGAGTAATCTA
TCAACCCCATGTACCATCaatatctatccatcaactaatgcaGAGTAAGCCGAGTAATCTA
TCAACCCCATGTACCATCaatatcaaatatccaattgcaagatttgatcaaatgcaGAGTAAGCCGAGTAATCTA Mir-17-92N2C2

TCAAATATTTCTCCCCTTCtgcaGAGTAAGCCGAGTAATCTA
TCAAATATTTCTCCCCTTCccctcaGAGTAAGCCGAGTAATCTA
TCAAATATTTCTCCCCTTCccctgcaGAGTAAGCCGAGTAATCTA
TCAAATATTTCTCCCCTTCccagggaggaAGTAAGCCGAGTAATCTA
TCAAATATTTCTCCCCTTCccctcggcaGAGTAAGCCGAGTAATCTA
TCAAATATTTCTCCCCTTCccctaatgcaGAGTAAGCCGAGTAATCTA
TCAAATATTTCTCCCCTTCccctctaatgcaGAGTAAGCCGAGTAATCTA
TCAAATATTTCTTTCCTTCccttccctccccaGAGTAAGCCGAGTAATCTA
TCAAATATTTCTCCCCTTCccctcttaaaaatgcaGAGTAAGCCGAGTAATCTA
TCAAATATTTCTCCCCTTCtcccccttccccagaatgcaGAGTAAGCCGAGTAATCTA

*Fig. 9 (cont'd)*

Mir-430N1: mutations in 7 of 20 sequences (~35.0%)
CTAACGTTACATGTAAATCAAATCATTTGTTTAGTTTTTCTACTGGACATGAAC
CTAACGTTACATGTAAATCAAATtatttggttaaTTTTTCTACAGGACATGAAC
CTAACGTTACATGTAAATCAAATCATT-GTTTAGTTTTTCTACTGGACATGAAC
CTAACGTTACATGTAAATCAAATCA---aaTTAGTTTTTCTACTGGACATGAAC
CTAACGTTACATGTAAATCAAATCATTT----AGTTTTTCTACTGGACATGAAC
CTAACGTTACATGTAAATCAAA-------TTTAGTTTTTCTACTGGACATGAAC
CTAACGTTACATGTAAAT----------acaTAGTTTTTCTACTGGACATGAAC
CTAACGTTAG-----------------------TTTTTCTACTGGACATGAAC Mir-430N2: mutations in 13 of 19 sequences (~68.4%)
TTACATCTGTATTTTAACATTGTTCTAATTAAACACAGACACTGTGACTATTCAGAA
TTACATCTGTATTTTAACATTGTTT------AACACAGACACTGTGACTATTCAGAA
TTACATCTGTATTTTAACATTGTT-------AAACACAGACACTGTGACTATTCAGAA
TTACATCTGTATTTTAACATTGTTCTA-----------GACACTGTGACTATTCAGAA
TTACATCTGTATTTTAACATTGTTCT-----------GACACTGTGACTATTCAGAA X2
TTACATATGTATTTTAACATT------------AACAGACACTGTGACTATTCAGAA
TTACATCTGTATTTTAACA----------------CAGACACTGTGACTATTCAGAA
TTACATCTGTATTTTAACATTGTTCT-----------------GTGACTATTCAGAA
TTACATATGTATTTTAACATTGTTCT-------------------GACTATTCAGAA
TTACATCTGTATTTTAACATTGTTCTgtcaatattttaACAGACACTGTGACTATTCAGAA
TTACATCTGTATTTTAACATTGTTCatctgtattttAACACAGACACTGTGACTATTCAGAA
TTACATCTGTATTTTAACATTaacaattaaacattttaacaattAAACACAGACACTGTGACTATTCAGAA
TTACATCTGTATTTTAACATTgttcattgcaattccatgccaaatgggttcagtcttgcttgttgtacgtgtc
cttaTAAACACAGACACTGTGACTATTCAGAA Mir-430C1: mutations in 4 of 22 sequence (~18.2%)
ATACTTTTAATAAACCCCAGGGAATTTTGTCTTCTTGGATGGTGTAAGAAATGAG
ATACTTTTAATAAACCCCAGGGAATTT---CTTCTTGGATGGTGTAAGAAATGAG
ATACTTTTAATAAACCCCAGGGAATTT------CTTGGATGGTGTAAGAAATGAG
ATACTTTTAATAAACCCCAGGGAAT--------CTTGGATGGTGTAAGAAATGAG
ATACTTTTAATAAACCCCAGGGAAgaaccccagggaaCTTCTTGGATGGTGTAAGAAATGAG Mir-430C2 mutations in 13 of 19 sequences (~68.4%)
ATCCTTAAGAAGTCAAACCATTTGTATTGACCGAGGCAACAGAATCTGCATAGAG
ATCCTTAAGAAGTCAAACCAT-----gttgCCGAGGCAACAGAATCTGCATAGAG
ATCCTTAAGAAGTCAAACCATTTGT-------ttGGCAACAGAATCTGCATAGAG
ATCCTTAAGAAGTCAAACCAT--------ctctatGCAACAGAATCTGCATAGAG
ATCCTTAAGAAGTCAAACCA---------ACCGAGGCAACAGAATCTGCATAGAG
ATCCTTAAGAAGTCAAACCA----------CCGAGGCAACAGAATCTGCATAGAG X2
ATCCTTAAGAAGTCAAACCAT----------CGAGGCAACAGAATCTGCATAGAG
ATCCTTAAGAAGTCAAACCATTTG----------GCAACAGAATCTGCATAGAG
ATCCTTAAGAAGTCAAACC------------GAGGCAACAGAATCTGCATAGAG X2
ATCCTTAAGAAGTCAAACCA--------------GGCAACAGAATCTGCATAGAG
ATCCTTAAGAAGTCAAACCATTTGTAtTTGACCGAGGCAACAGAATCTGCATAGAG
ATCCTTAAGAAGTCAAACCATTTGaggcaacacACCGAGGCAACAGAATCTGCATAGAG

*Fig. 10*

Mir-430N1C1
TAACGTTACATGTAAATCaaatcttcttGGATGGTGTAAGAAATGA
TAACGTTACATGTAAATCaaatcacttcttGGATGGTGTAAGAAATGA
TAACGTTACATGTAAATCaaatcatttcttGGATGGTGTAAGAAATGA
TAACGTTACATGTAAATCaaatcatttcttcttGGATGGTGTAAGAAATGA
TAACGTTACATGTAAATCaaatcattcccttcttGGATGGTGTAAGAAATGA
Mir-430N2C1
TACATCTGTATTTTAACATtgttcttGGATGGTGTAAGAAATGA
TACATCTGTATTTTAACATtgtcttcttGGATGGTGTAAGAAATGA
TACATCTGTATTTTAACATtgttcttcttGGATGGTGTAAGAAATGA
TACATCTGTATTTTAACATtgttctatcttcttGGATGGTGTAAGAAATGA
TACATCTGTATTTTAACATtgttattattgtcttcttGGATGGTGTAAGAAATGA
Mir-430N1C2
TAACGTTACATGTAAATCaaatcgagGCAACAGAATCTGCATAGA
TAACGTTACATGTAAATCaaatccgagGCAACAGAATCTGCATAGAG
TAACGTTACATGTAAATCaaatcaccgagGCAACAGAATCTGCATAGA
TAACGTTACATGTAAATCaaatcaccgagGCAACAGAATCTGCATAGA
TAACGTTACATGTAAATCaaatcagtttgttaggacaccgagGCAACAGAATCTGCATAGA
Mir-430N2C2
TACATCTGTATTTTAACATtgttccgagGCAACAGAATCTGCATAGA
TACATCTGTATTTTAACATtgttctacagGCAACAGAATCTGCATAGA
TACATCTGTATTTTAACATtgttgttaaaacaatgttaAACAGAATCTGCATAGA
TACATCTGTATTTTAACATtgttctaattgaccgagGCAACAGAATCTGCATAGA
TACATCTGTATTTTAACATtgtttaacaatgttgccgagGCAACAGAATCTGCATAGA

Fig. 11

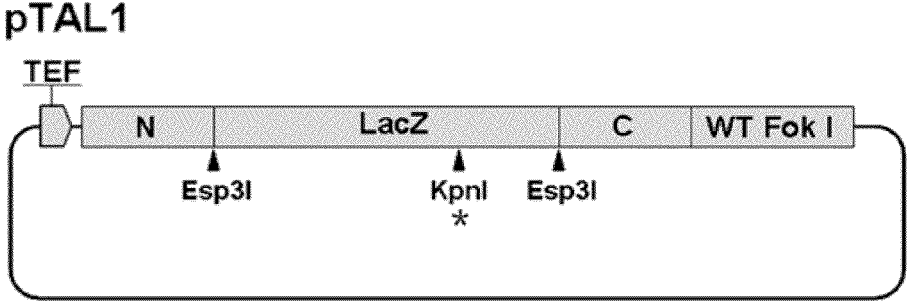
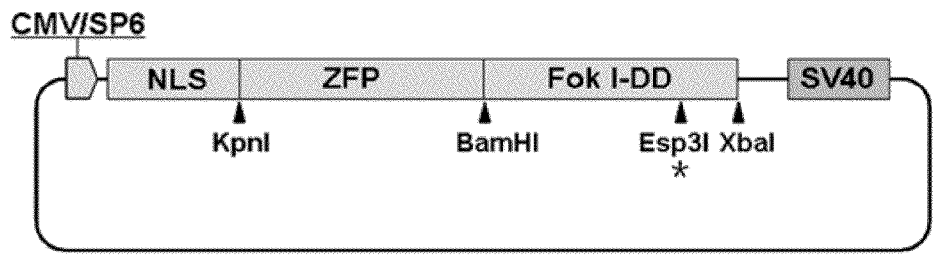
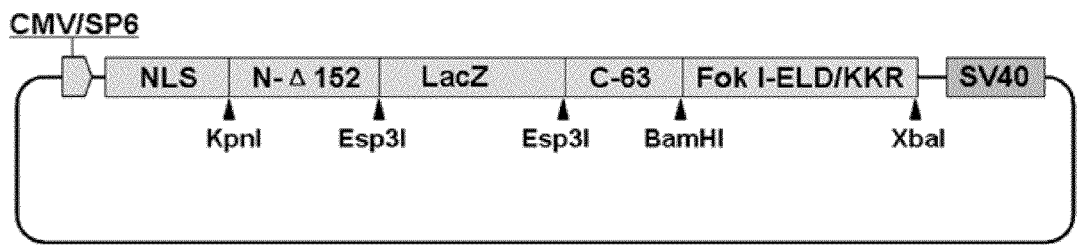
Fig. 13

C noggin TALEN

TCCTAGTGAAAACCTACCACTGGTGGACCTTATTGAGCATCCGGATCCTA

| | |
|---|---|
| TCCTAGTGAAAACCTA------------------------------------------- | (Δ274) |
| GTCTTCCTG------------//------------GGAGGAGAGACTTGGAG | (Δ197) |
| ---------------------------------CCTTATTGAGCATCCGGATCCTA | (Δ57) |
| TCCTAG---------------------------TTGAGCATCCGGATCCTA | (Δ26)   [×2] |
| TCCTAGTGAAAACCTAC-----------------TGAGCTCCGGATCCTA | (Δ17,+1) |
| TCCTAGTGAAAACC------------------TATTGAGCATCCGGATCCTA | (Δ16) |
| TCCTAGTGAAA-------------------ACCTTATTGAGCATCCGGATCCTA | (Δ15) |
| TCCTAGTGAAAACCTACCAC------------TGAGCATCCGGATCCTA | (Δ13) |
| TCCTAGTGAAAACCTACC------------TTATTGAGCATCCGGATCCTA | (Δ11) |
| TCCTAGTGAAAA-CTA---------GGAtgCTTATTGAGCATCCGGATCCT | (Δ11,+2) |
| TCCTAGTGAAAACCTACCACT--------TTATTGAGCATCCGGATCCTA | (Δ9)   [×2] |
| TCCTAGTGAAAACCTACC------------ACCTTATTGAGCATCCGGATCCTA | (Δ8)   [×11] |
| TCCTAGTGAAAACCTACCACTGG---------TATTGAGCATCCGGATCCTA | (Δ7) |
| TCCTAGTGAAAACCTACCtC--------ACCTTATTGAGCATCCGGATCCTA | (Δ7,+1)   [×2] |
| TCCTAGTGAAAACCTACCAcCT-----ACCTTATTGAGCATCCGGATCCTA | (Δ5,+1)   [×5] |
| TCCTAGTGAAAACCTACCACTaccacctaccACCTTATTGAGCATCCGGA | (Δ5,+10) | ptf1a/p48 TALEN

TTCACTGACCATTCCTCTAGGGACGCCCTGGACCCAGACGACTTTTGGA

| | |
|---|---|
| -------------------------------tCTGGACCCAGACGACTTTTGGA | (Δ126,+1) |
| ----------------------------------CCCAGACGACTTTTGGA | (Δ99) |
| TTCACTGACCATT-------------------CCCAGACGACTTTTGGA | (Δ19) |
| TTCACTGACCATTCCT----------CTGGACCCAGACGACTTTTGGA | (Δ11)   [×2] |
| TTCACTGACCATTCCTCTA---------GGACCCAGACGACTTTTGGA | (Δ10) |
| TTCACTGACCATTCCT---------CCTGGACCCAGACGACTTTTGGA | (Δ10) |
| TTCACTGACCATTCCTCTAGG-A-----aTGGACCCAGACGACTTTTGGA | (Δ6,+1) |
| TTCACTGACCATTCCTCTAGGGA------aTGGACCCAGACGACTTTTGGA | (Δ5,+1)   [×2] |
| TTCACTGACCATTCCTCTAGGA-GCCCTGGACCCAGACGACTTTTGGA | (Δ1) |

ets1 TALEN

```
TTACTCTGAAAGGAGTGGACTTTCAGAAGTTCTGTATGAGCGGAGCAGCA

TTACTCTGAAAGGAGTGGACTTT---------------------------    (Δ403)
-------------------------------TATGAGCGGAGCAGCA       (Δ400)
TTACTCTGAAAG------------------------GAGCGGAGCAGCA     (Δ25)
TTACTCTGAAAGGA------------------GTATGAGCGGAGCAGCA     (Δ19)
TTACTCTGAAAGGAG-----------------cGTATGAGCGGAGCAGCA    (Δ18,+1)
TTACTCTGAAAGGAGTGG---------------ATGAGCGGAGCAGCA      (Δ17)
TTACTCTGAAAGGAGTGGA------------CTGTATGAGCGGAGCAGCA    (Δ12)
TTACTCTGAAAGGAGT------------GTTCTGTATGAGCGGAGCAGCA    (Δ12)
TTACTCTGAAAGGAGTG-----------GcTCTGTATGAGCGGAGCAGCA    (Δ12,+1)
TTACTCTGAAAGGAGTG-----------GTTCTGTATGAGCGGAGCAGCA    (Δ11)
TTACTCTGAAAGGAGT-----------AGTTCTGTATGAGCGGAGCAGCA    (Δ11)
TTACTCTGAAAGGAGTGGAC----------TCTGTATGAGCGGAGCAGCA    (Δ10)
TTACTCTGAAAGGAGTGG---------AGcTCTGTATGAGCGGAGCAGCA    (Δ10,+1)
TTACTCTGAAAGGAGTGGAC---------TTCTGTATGAGCGGAGCAGCA    (Δ9)       [×2]
TTACTCTGAAAGGAGT--ACT-----cAGTTCTGTATGAGCGGAGCAGCA    (Δ8,+1)
TTACTCTGAAAGGAGTGGACT-------GTTCTGTATGAGCGGAGCAGCA    (Δ7)
TTACTCTGAAAGGAGTGGACTT-------TTCTGTATGAGCGGAGCAGCA    (Δ7)
TTACTCTGAAAGGAGTGGACTT------GTTCTGTATGAGCGGAGCAGCA    (Δ6)
TTACTCTGAAAGGAGTGGAC-----aAAGTTCTGTATGAGCGGAGCAGCA    (Δ6,+1)
TTACTCTGAAAGGAGTGGACTT----AtGTTaTGTATGAGCGGAGCAGCA    (Δ6,+2)
TTACTCTGAAAGGAGTGGACTTT----tGTTCTGTATGAGCGGAGCAGCA    (Δ5,+1)
TTACTCTGAAAGGAGTGGACTgT---AAGTTCTGTATGAGCGGAGCAGCA    (Δ4,+1)
```

*Fig. 15 (cont'd)*

D
noggin ZFN

```
GGACCTTATTGAGCATCCGGATCCTATCTATGATCCCAAGGAGAAGGATCTT

ACCTACCAC------------//----------------AT---CCTAGGGACCAG    (Δ332)
CTTATTGAGCAT---------//----------------CCACTTTGACCCCA       (Δ68)
GGACCTTATTGAG------------------------CAAGGAGAAGGATCTT       (Δ23)
GGACCTTATTGAGCATCCGGAT---------------CAAGGAGAAGGATCTT       (Δ14)
GGACCTTATTGAGgA------CCT-TC----TCCCAAGGAGAAGGATCTT          (Δ14,+1)
``` ptf1a/p48 ZFN

```
CTGGAGTCCTTCCCTTCCCCGTACTTCGATGAGGATGATTTCTT

-------------------------tCTTCGATGAGGATGATTTCTT    (Δ24,+1)
CTGGAGTCCTTCCCTTC----------------GATGATTTCTT        (Δ16)
CTGGAGTCCTTCC----------CTTCGATGAGGATGATTTCTT        (Δ10)      [×3]
CTGGAaTCCTTCC----------CTTCGATGAGGATGATTTCTT        (Δ10,+1)
CTGGAGTCCTTCCCTTC--------CGATGAGGATGATTTCTT         (Δ9)
CTGGAGTCCTTCCCTTCC-------tGATGAGGATGATTTCTT         (Δ9,+1)
CTGGAGTCCTTCCCTTC------CTTCaATGAGGATGATTTCTT        (Δ7,+1)
CTGGAGTCCTTCCCTTCC-----CTTCGATGAGGATGATTTCTT        (Δ5)       [×2]
```

*Fig. 15 (cont'd)* noggin

GGTGATCGAGCTGAAAGTGAAGAATATTTAAGAGAGGGGAGGCTGGAGGCAGCAGGC
AGACACAGTGGTGCCACCAAGGGCTGTGCGTAAGGGGCAGGGGAGACAGACGGGGCT
CTGAACTTCCACTTGTCTGCAATGAGAGGGGGGTGCCCCTGAACCCCCCCAATTCCT
CCTCTGATGCATTATTTATGATCTCTGGCAAGAAATCGGGAGCACCCTACTCTTATA
TTGTGCAGCTGTGTGCAGC**ATGGATCATTCCCAGTGCCTTGTGACTATATATGCTCT
CATGGTCTTCCTGGGACTTAGAATAGACCAGGGGGGCTGCCAACATTATCTGCACAT
CAGACCAGCTCCTAGTGAAAACCTACCACTGGTGGACCTTATTGAGCATCCGGATCC
TATCTATGATCCCAAGGAGAAGGATCTTAATGAGACCTTGCTGAGGACTTTAATGGT
TGGCCACTTTGACCCCAACTTTATGGCCATCAACCTGCCGGAGGAGAGACTTGGAGT
GGAGGACCTTGGGGAGTTGGATCTCCTTCTTAGGCAGAAGCCCTCAGGGGCAATGCC
AGCAGAAATCAAAGGACTGGAATTTTATGAGGGGCTTCAGGGCAAAAAGCACAGACT
GAGCAAGAAACTCAGGAGAAAGTTGCAGATGTGGCTCTGGTCCCAGACCTTCTGTCC
TGTCCTTTACACATGGAATGACCTAGGGACCAGGTTTTGGCCTCGCTATGTGAAAGT
AGGTAGCTGCTACAGTAAGAGGTCTTGTTCTGTGCCAGAGGGCATGGTTTGCAAAGC
TGCCAAGTCTATGCATTTGACCATCTTAAGGTGGAGATGTCAACGCAGGGTTCAGCA
GAAGTGTGCATGGATAACCATTCAGTACCCTGTCATATCTGAGTGCAAATGTTCATG
TTGA**GACTCTTGGACTAATGCAAAAG

Fig. 16 ptf1a/p48

GCAGAAGCGCAATGCTATGTACTATAAAGCTACACGGCGCAGTATGGTGCTGCTCTC
TGTATACTCAGCGCTCTCCCTATTCTGTGCAGCATCCCAGTGCCACATACTAGGGGA
CAGGAAACCCCCTGGCACCCAGTAACATACAGTAAGGATGTCGGTGCCATTCCCGGT
GCCTGGGAGGAGCTGTCAGTCGCTGTTACTGGTGCCTACAGGAGATGCCAGGGGATT
CTCTGCCCCAAAGCGCAGATCTGACAGGGACCATGTGGGCACCCGATGCGCCGAGAG
CTGTCACTGTACCAGGAGGCGTGTCCCCGGGGCCCCTCCCACCAGGCAAGGTGCTG
AAGCGGAGAGGGGGAGGCAATGGAGCACTGTGATTGGCTGCGGCTGCGGGCATTGGC
ACGCTTGCTGCTTGTACCTATAAGTACTCCCGTGTGGGACTTCAACTTCAGCCTCAA
AGTCCCGAACCGAGTGAGGAGCCCCCGGAACCGCAGCATCACCCGGGCCGGCACC**AT
GGAAACGGTACTGGAGCAGTTCGCAGGGCTGGA**GTCCTTCCCTTCCCCGTACTTCGA
TGAGGATGAT**TTCTTCACTGACCATTCCTCTAGGGACGCCCTGGACCCAGACGACTT
TTTGGAAGACGATGTGGACTTCTTGGCCGGTCAGATCCAAGACTATTACCGGGACAG
CCGGGGGCTGCACACTGATGATGAATACTGCGATGCCGGCAACTTCTCCTTCTCATC
CTCCTCTTCGGGGGGCTTCCCCTATGAATGTGGGGAGGGAGGCTGCGAATTGTCGCC
GGGGATGAAGGGAGGGAGTCTGGTGATGAAGAGGAGGAGGAGGCTGAGGTCGGACGC
GGAGATGCAGCAGCTCAGGCAGGCGGCCAATGTCAGGGAGCGGCGCAGGATGCAGTC
CATCAATGACGCCTTTGAGGGGCTCCGCTCGCACATCCCCACTCTGCCCTACGAGAA
GCGACTGTCCAAGGTAGACAC**

**ets1a *X. laevis***

ATCCCCGAGAATGGACAGACATGCATGTGAGAGAGTGGGTCTCGTGGGCAGTGAATG
AATTTACTCTGAAAGGAGTGGACTTTCAGAAGTTCTGTATGAGCGGAGCAGCATTAT
GTGCCCTGGGGAAGGAATGCTTCCTAGAACTGGCACCAGACTTTGTGGGAGATATCT
TATGGGAGCACTTGGAGATCTTGCAGAAAG

*Fig. 16 (cont'd)*

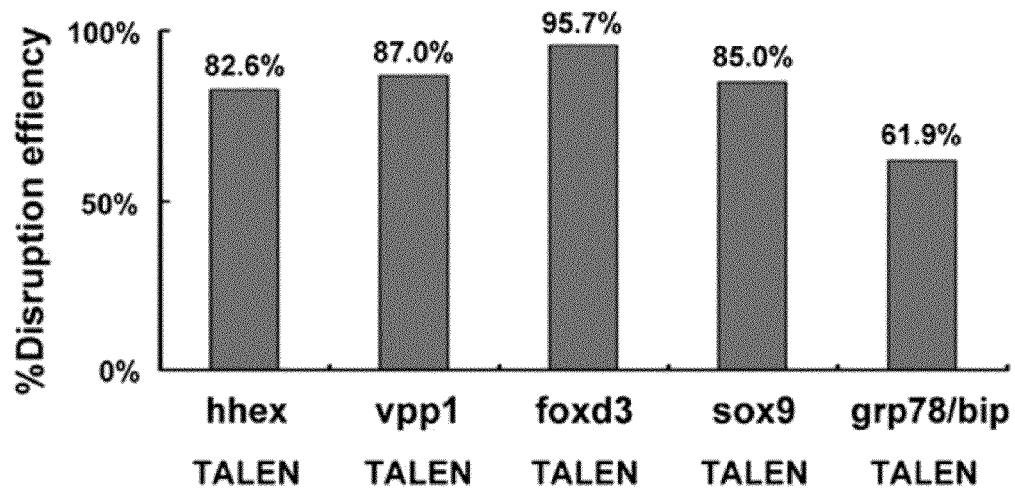
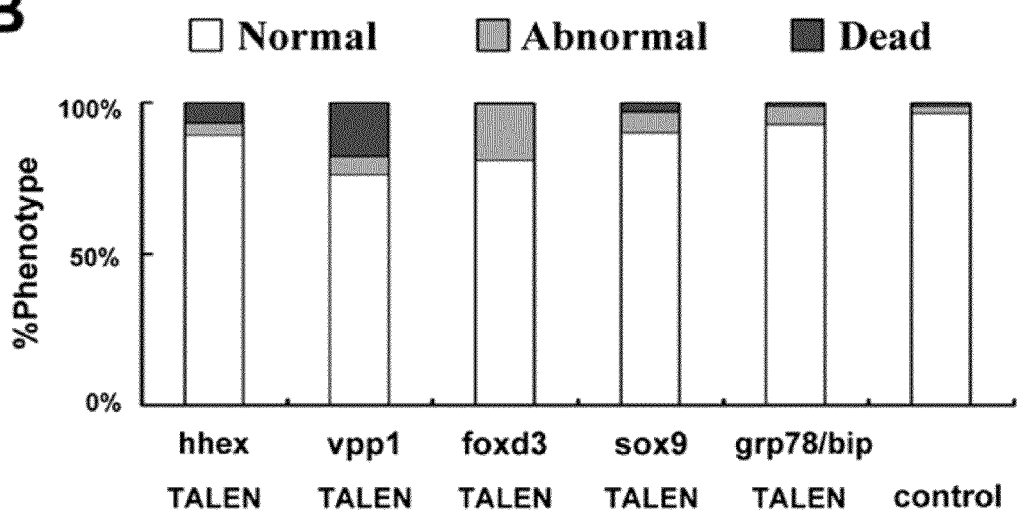
*Fig. 18*

C hhex

TTACAACTGTGCACATTAACTGCTGCTCAGTAAGAATGGACCTCTCTTCA

| | |
|---|---|
| TTACAACTGTGCACATTAA------------------------------- | (Δ283) |
| TTACAACTGTGCACAT----------------------------CTCTCTTCA | (Δ25) |
| TTACAACTGTGCACATTAA-------------------------CTCTCTTCA | (Δ22) |
| TTACAACTGTGCACATTAAC-----------------TGGACCTCTCTTCA | (Δ16) |
| TTACAACTGTGCACAT--------------TAAGAATGGACCTCTCTTCA | (Δ14) |
| TTACAACTGTGCACAT----------CAGctgGAATGGACCTCTCTTCA | (Δ14,+3) |
| TTACAACTGTGCACATTAACT------------GAATGGACCTCTCTTCA | (Δ12)  [×2] |
| TTACAACTGTGCACATTAACTG----------aAATGGACCTCTCTTCA | (Δ12,+1) |
| TTACAACTGTGCACAT----------CAGTAAGAATGGACCTCTCTTCA | (Δ11) |
| TTACAACTGTGCACAgTAA---------CAGTAAGAATGGACCTCTCTTCA | (Δ9,+1) |
| TTACAACTGTGCACATTAA--G------AGTAAGAATGGACCTCTCTTCA | (Δ8) |
| TTACAACTGTGCACATTAA----------CAGTAAGAATGGACCTCTCTTCA | (Δ8)  [×3] |
| TTACAACTGTGCACATTAACTGCT---CAGTAAGAATGGACCTCTCTTCA | (Δ3) |
| TTACAACTGTGCACATTAACTGCatttaCTGcattaaccgCAGTAAGAAT | (Δ1,+14) |
| TTACAACTGTGCACATTAACTGCaGcacattaaCTCAGTAAGAATGGACC | (Δ1,+9) |
| TTACAACTGTGCACATTAACTGCacattaaCTCAGTAAGAATGGACCTCT | (Δ2,+7) | vpp1

TCAGTCTTGGCCTTCAGGATAAACTTCATGCCCCTACAGCAAACTGGGGA

| | |
|---|---|
| TCAGTCTTGGCCTTCAGGATAAAC-------------------------- | (Δ213) |
| TCAGTCTTGGCCTT-------------------CAGCAAACTGGGGA | (Δ22) |
| TCAGTCT--------------------TGCCCCTACAGCAAACTGGGGA | (Δ21) |
| TCAGTCTTGG------------------CCCTACAGCAAACTGGGGA | (Δ21) |
| TCAGTCTTGGCCTTCAGG------------CCTACAGCAAACTGGGGA | (Δ14) |
| TCAGTCTTGGCCTTCAGGATAA-----------ACAGCAAACTGGGGA | (Δ13) |
| TCAGTCTTGGCCcccCAG------TT--TGCCCCTACAGCAAACTGGGGA | (Δ11,+2) |
| TCAGTCTTGGCCTaCAG---cAAgTT--TG--CCTACAGCAAACTGGGGA | (Δ10,+3) |
| TCAGTCTTGGCCTTCAG---------TCtTgGCCCCTACAGCAAACTGGGGG | (Δ9,+2) |
| TCAGTCTTGGCCTTCAGGAT--------GCCCCTACAGCAAACTGGGGA | (Δ9) |
| TCAGTCTTGGCCTTCAGGATA--------TGCCCCTACAGCAAACTGGGGA | (Δ7) |
| TCAGTCTTGGCCTTCAGGATAAAC--------CCCTACAGCAAACTGGGGA | (Δ7) |
| TCAGTCTTGGCCTTCAGGATAAA--------CCCCTACAGCAAACTGGGGA | (Δ7) |
| TCAGTCTTGGCCTTCAGGATAAACT--AT---CCTACAGCAAACTGGGGA | (Δ5) |

foxd3

TGTTCGACAATGGCAGTTTCCTCAGGAGAAGGAAGCGCTTTAAGAGACAA

| | |
|---|---|
| ------------------------aAAGCGCTTTAAGAGACAA | (Δ94,+1) |
| -------------------------AGAAGGAAGCGCTTTAAGAGACAA | (Δ70) |
| TGTTCGACAATGGCAGT--------------------TTTAAGAGACAA | (Δ21) |
| TGTTCGACAAT------------------GGAAGCGCTTTAAGAGACAA | (Δ19) |
| TGTTCGACAATGGC-------------------AGCGCTTTAAGAGACAA | (Δ19) |
| TGTTCGACAATGGC------------------AGGAAGCGCTTTAAGAGACAA | (Δ15) |
| TGTTCGACAATGGCAGTTTCCT------------CTTTAAGAGACAA | (Δ15) |
| TGTTCGACAATGGCAGTTTCCT------------GCTTTgAGAGACAA | (Δ15,+1) |
| TGTTCGACAATGGC-----------AGAAGGAAGCGCTTTAAGAGACAA | (Δ12) |
| TGTTCGACAATGGCAGTTTCCT------------GCGCTTTAAGAGACAA | (Δ12) | sox9

TTTCCTGTGTGCATCAGAGAGGCGGTCAGCCAGGTGCTGAAGGGATATGA

| | | |
|---|---|---|
| TTTCCTGTGTGCA-------------TCAGCCAGGTGCTGAAGGGATATGA | (Δ12) | [×3] |
| TTTCCTGTGTGCATCAGAG-------AGCCAGGTGCTGAAGGGATATGA | (Δ8) | |
| TTTCCTGTGTGCATCAGAGAGG-------CAGGTGCTGAAGGGATATGA | (Δ8) | |
| TTTCCTGTGTGCATCAGAGAGGCG-------GGTGCTGAAGGGATATGA | (Δ8) | |
| TTTCCTGTGTGCATC-----CcaTCAtCatCAtaTGCTGAAGGGATATGA | (Δ12,+7) | |
| TTTCCTGTGTGCATCAGAGAGG-----tGCCAGGcGCTGAAGGGATATGA | (Δ7,+2) | |
| TTTCCTGTGTGCATCAGAGAGG-----tGCCAGGTGCTGAAGGGATATGA | (Δ6,+1) | | grp78/bip

TGCCAGCGTATTTGCTGCTGATGATGATGACAAGAGGGAAGATGTTGGGA

| | | |
|---|---|---|
| -------------------------------TGACAAGAGGGAAGATGTTGGGA | (Δ364) | |
| TGCCAGCGTATTTGCTGCTGAT--------------GGGAAGATGTTGGGA | (Δ12) | [×2] |
| TGCCAGCGTATTTGCTGC---------TGACAAGAGGGAAGATGTTGGGA | (Δ9) | |
| TGCCAGCGTATTTGCTGC------TGATGACAAGAGGGAAGATGTTGGGA | (Δ6) | [×9] |
| TGCCAGCGTATTTGCTGC---TGATGATGACAAGAGGGAAGATGTTGGGA | (Δ3) | [×2] |
| TGCCAGCGTATTTGCTGCTGATgactccaaggGAaGATGACAAGAGGGAA | (Δ1,+11) | |

*Fig. 18 (cont'd)* hhex

ACATGAAAACCTGTGTTTTTGTAACATCAATGTGTCATCTGACCGGCAATGCAACAG
ATGAGTGAACAGCTTATTGGGTTTCTAGTACTGATTGTACAGTTCATTCAAAACTGT
TAACTGACTTTTCTATTTTAGAGCCAAATGGAGGCGTCTCAAGCAG**GAAAACCCACA
GGGAAATAAGAAAGACGAAACTGAAAGTCTAGAGAATATCTGCGAAGAGAGTCAGGA
GAGGTGTTTGAGTGCTGAGCAGAAGAGCAGAGAGTCCTCCTTGGATGAACCCACCTC
ATCGCCCACCTCCCAAGAGACTCTGGATTCAGAGGTGTCCGATGATTCCGACCAGGA
GGTGGACATTGAAGGAGACAAAGGATTTTA**CAACTGTGCACATTAACTGCTGCTCAG
TAAGAATGGACCTCTCTTCAGCTTGCACTTTAACAGAAGCTGGACCTAGCTCCCTGG
TAGCCTGACTTGGGTTAAGCCAGTGGCTGTCGGACTTTCTCAGTTCAAGCCCCCACT
GGAGTTCCAACCTTTGTTCAGGGCCCCCTCAGCTCATAACAAGGAAAGCAGCGGTGT
ACCAGTCAGAGCAGAAAATACATTTTTATCCCAAATCTTATCCTAATTAACCTTCAA
GTTGGAGGTATCTAGGAGAGCAAGTAGGCATTCTCCTCAAATTTCATTCTTTATTGA
CCTTTCAGGTGTATTTAGGAGAGCAAATAGGCATCCTCCCTAATTCTCACCCTAACT
GGCAAGCTTCTATCCCACAGTGGCACAGTTTGGGAACCACTGAGTTAAGGGGATGGA
AAGGACATTTTATCAGTGTATATCAAGGTTTAGTTTGATCATGGTCAAAGTTCTATT
TCAGATTGTGTATTTATCATAAACGGTGTTACTGTAATATTTTGCCTAATTGCACAA vpp1

AAACTCTGCCCATTATACTGGCATTTGAAGGGTTAATATATACCAAGCACAGTACAA
GTACATATTGTACTTAGTCTGGTCCTAAACGCTGCCCATTGGTAGGGATGTAGTACT
GCAGAATGGCCATCAGGTGTCGCTGCTTTAGCTCTCTGCACAATAGAAATAGAATGT
GATATCAAAGCTGTAATTTGCCAATTGAATTACTTCGGTGCCAGTATTAATTTAACT
ATTATAATCAATGCATCAAATTAAGTTGTCTTCAGTCCCCGCCCCCAACGGGAGCC
AATGGGTGTCTTAACAAGCAGGATTCCTTTAGGAGATCGCGTTGGTCACATTCTCTG
GCACCCATTGGCCCCTAATAATAAAAATAATAAAGGGGTACAGCCCTTAAATTGTGA
TGTCATTGTCTATAGTAATCCCTGACGTATTATCTCATTGCAG**AAATGATGTCAGCA
GTACGGAGCTCCTCCTTCAGATGGGCTGGGCCACAGACCACACCCATATTCCTTGGG
CTCCTCCTCCTTCAGT**CTTGGCCTTCAGGATAAACTTCATGCCCCTACAGCAAACTG
GGGGAAGAGGATGAGAGTGGGACATCCCCGCTGAGAATGCTGGGTAACTGGCTGAGG
GACTGTCACATGGTGTCAATGACACAGGGGATTGGCTGCCGGTGCCACCCCACAATC
TGTATATACTGTATATAGTGTATATCCTCCCCATTCCCCATATCCCCTTACACACTC
ACTTCTTTATTTAGTTTTTATTATCAGCAATAAATCTGCTCAATTGGTTTGATTTAT
ATTTTGGTGCTTAGTTCTACTTATTCATCAGCAAGAAACAGAACGTGTTATGTGTG
TGCA

sox9

CTCAACTCTCTTCGCCAACTTTCTCTCCATTCTCTTCGCACCGTTTTGCGCATGAAT
CTCTTGGATCCCTTCATGAAGATGACAGAAGAGCAAGATAAGTGCATGTCCGGGGCC
CCCAGCCCAACAATGTCCGAGGACTCGGCTGGCTCCCCATGCCCCTCCGGCTCTGGC
TCCGACACGGAGAACACCAGACCCCAAGAGAACACTTTCCCCAAAGGGGACCCGGAG
CTGAAGAAGGAGACAGAGGACGAAAAGTTTCCTGTGTGCATCAGAGAGGCGGTCAGC
CAGGTGCTGAAGGGATATGACTGGACCCTGGTACCGATGCCAGTCAGAGTTAATGGA
TCCAGCAAGAGCAAGCCTCATGTCAAGAGACCCATGAACGCCTTCATGGTGTGGGCA
CAGGCTGCAAGGAGGAAGCTGGCCGACCAATACCCCATCTGCACAATGCAGAACTC
AGCAAGACTCTGGGCAAGTTATGGAGGTAAGTGGCCACCTCTGTGAGCTTGGGGTTG
AAGGTGTTAACATGCATGTAACCTCTTTTCATATGGTGGGAAATTGGGGAGGAGTTG
GTTTTGATGCAAAATGTGGTTATTGCTGTGCGCCTCTGTATTGCGCAGCTGTATTGG
CACTTTGCGCTTTGTGCGCGTCTGTAACTCTCTTGCCTGTCTGCTGGCGGCTCCCTT
GGCACTGTATTCCAGGCTTGCCAGGGATGTGCTGTAGGTCTGTATCGGTACAGCCAA
GA foxd3

GAGCGGCATCTGTGAGTTCATCAGCAACCGCTTCCCCTACTATCGGGAGAAGTTCCC
GGCCTGGCAGAACTCCATCCGCCACAATCTCTCGCTTAATGACTGCTTCGTCAAAAT
CCCCCGGGAGCCCGGAAACCCAGGCAAGGGAAACTACTGGACCCTGGACCCCCAGTC
CGAGGACATGTTCGACAATGGCAGTTTCCTCAGGAGAAGGAAGCGCTTTAAGAGACA
ACAGCCGGACTCATTGAGGGAGCAGACGGCTCTCATGATGCAAAGCTTTGGGGCTTA
CAGCCTGGCCGGTCCCTATGGGCGCCCTATGGGCTCCACCCTGCAGCCTACACTCA
CCCTGCTGCCCTGCAGTATCCTTACATCCCCCGGTGGGCCCATGTTACCCCGGC
GGTGCCACTTCTGCCTTCCTCTGAACTGAGCAGGAAAGCCTTCAGCTCGCAGCTCAG
CCCCAGCCTCCAGCTGCAGCTCAGCAGCCTCAGCAGTACCGCAGCCTCCATCATTAA
GTCTGAGCCCAGCAGCCGACCCTCCTTCAGCATAGAGAACATTATTGGGGTATCGGC
AGCCTCCTCGATA

grp78/bip

AAACCCTATTGAATTAGTTGGAGGCATATGAATTTTGTGCATGTTGGGATATGCGGC
AGCTTGTCTGCTGAATAATGGGCAGAGTGCTGCCTCTAGAATGTTCTTTCCCACCGC
CCATGTCTGAATCAGCGTGTTTCCCCATTGGCTGCTGAGAAGGGCTCCCTTTAAAGA
CGCCTCCCATCCATGGCTCGGCCTACTATTATCCCCCTTGTATCGTGCTAGAGTGGA
GCTGGTAACTGTTTTACTGCCAGAGTGGAATAACCACACATACGCTGCTTAATACCT
TATGCTACTGCTTTGGTGTTAAAAGCATCTTTTATATATTTCATTTGTCTTTTTATA
GTGTGGTGCACAACTTCATTTCATAACTGGTTGTGACAAACAAATCTCATGGTGACC
ATGAAGCTGTTTGCCTTGGTGTTGCTGGTGTCTGCCAGCGTATTTGCTGCTGATGAT
GATGACAAGAGGGAAGATGTTGGGACTGTGGTTGGAATTGATTTGGGAACAACATAT
TCCTGGTAAGTAGTCCTCACAGAACCAAAAAATGTTTTATTTTTATTATCAAAGCTG
GGAAATAAGCTAATAAGCTAATGGCTCATTGGTTTTTTCTAGTCGGAATACTTGAGC
ACAGACCTGTGCATTTTTAATAAATGTGCTATTTATTAGAAAATGTTATTCTCTGCA
GTGTTTGGACTTAATTAGGCACTGTGGAGGCTATAAAATCTCTGGCCTTTGTGCCCC
TATATATAATAATAACCAGTTCTCTTATCTGTCTTTGCAAATACAATGTGGCATTAA
GGAATCTGTATTTATAACTTCAGGTAGCAATGTACATCTTCATAGTACAATAATAGT
ATGGACAGGGGAAATGACACTGCAAAGAATGTGAATTTATAATTATAATGGTTTGA
GTCACATGTTAAGGGA

*Fig. 19 (cont'd)*

| seq | strand from to | mism | gaps | act_len/exp_len |
|---|---|---|---|---|
| *noggin* | | | | |
| gi\|288985945\|ref\|NW_003163360.1\| | 2073824-2074546 | 6 | 0 | 723/0-1000 |
| gi\|288985918\|ref\|NW_003163387.1\| | 2277512-2277776 | 6 | 2 | 265/0-1000 |
| gi\|288985861\|ref\|NW_003163444.1\| | 1215851-1216206 | 6 | 2 | 356/0-1000 |
| gi\|288985791\|ref\|NW_003163514.1\| | 1698652-1698913 | 6 | 2 | 262/0-1000 |
| gi\|288985787\|ref\|NW_003163518.1\| | 1571352-1572267 | 6 | 2 | 916/0-1000 |
| gi\|288985722\|ref\|NW_003163583.1\| | 1156015-1156384 | 6 | 1 | 370/0-1000 |
| gi\|288985692\|ref\|NW_003163613.1\| | 1208909-1208948 | 6 | 2 | 40/0-1000 |
| gi\|288985662\|ref\|NW_003163643.1\| | 293721-293768 | 0 | 0 | 48/0-1000 |
| gi\|288985626\|ref\|NW_003163679.1\| | 626270-626684 | 6 | 2 | 415/0-1000 |
| gi\|288985228\|ref\|NW_003164077.1\| | 223376-223659 | 6 | 1 | 284/0-1000 |
| gi\|288984831\|ref\|NW_003164474.1\| | 108433-109069 | 6 | 2 | 637/0-1000 |
| *p48/ptf1a* | | | | |
| gi\|288985932\|ref\|NW_003163373.1\| | 2305676-2305723 | 0 | 0 | 48/0-1000 |
| gi\|288985273\|ref\|NW_003164032.1\| | 263266-263603 | 6 | 1 | 338/0-1000 |
| gi\|288984947\|ref\|NW_003164358.1\| | 108734-109330 | 5 | 1 | 597/0-1000 |
| *ets1* | | | | |
| gi\|288985961\|ref\|NW_003163344.1\| | 4279135-4279971 | 6 | 1 | 837/0-1000 |
| gi\|288985941\|ref\|NW_003163364.1\| | 1991068-1991341 | 6 | 2 | 274/0-1000 |
| gi\|288985933\|ref\|NW_003163372.1\| | 1530431-1530955 | 6 | 2 | 525/0-1000 |
| gi\|288985906\|ref\|NW_003163399.1\| | 702762-703513 | 6 | 2 | 752/0-1000 |
| gi\|288985887\|ref\|NW_003163418.1\| | 270306-271139 | 6 | 2 | 834/0-1000 |
| gi\|288985881\|ref\|NW_003163424.1\| | 164895-165048 | 6 | 1 | 154/0-1000 |
| gi\|288985867\|ref\|NW_003163438.1\| | 2162846-2163776 | 6 | 2 | 931/0-1000 |
| gi\|288985866\|ref\|NW_003163439.1\| | 1423470-1424410 | 6 | 1 | 941/0-1000 |
| gi\|288985863\|ref\|NW_003163442.1\| | 1457591-1457638 | 0 | 0 | 48/0-1000 |
| gi\|288985827\|ref\|NW_003163478.1\| | 921348-921443 | 6 | 2 | 96/0-1000 |
| gi\|288985812\|ref\|NW_003163493.1\| | 104588-104797 | 6 | 2 | 210/0-1000 |
| gi\|288985781\|ref\|NW_003163524.1\| | 922649-923559 | 6 | 1 | 911/0-1000 |
| gi\|288985747\|ref\|NW_003163558.1\| | 777251-777913 | 6 | 2 | 663/0-1000 |
| gi\|288985699\|ref\|NW_003163606.1\| | 994710-995199 | 4 | 2 | 490/0-1000 |
| gi\|288985627\|ref\|NW_003163678.1\| | 9213-9597 | 5 | 2 | 385/0-1000 |
| gi\|288985546\|ref\|NW_003163759.1\| | 51314-52029 | 5 | 2 | 716/0-1000 |
| gi\|288985427\|ref\|NW_003163878.1\| | 398598-399096 | 6 | 2 | 499/0-1000 |
| gi\|288985425\|ref\|NW_003163880.1\| | 400854-401300 | 5 | 2 | 447/0-1000 |
| gi\|288985381\|ref\|NW_003163924.1\| | 593713-594540 | 6 | 2 | 828/0-1000 |
| gi\|288984795\|ref\|NW_003164510.1\| | 39050-40075 | 3 | 1 | 1026/0-1000 |
| gi\|288984761\|ref\|NW_003164544.1\| | 26290-26601 | 6 | 1 | 312/0-1000 |

*Fig. 20*

A
ets1 TALEN targeted F1 embryos

```
TTACTCTGAAAGGAGTGGACTTTCAGAAGTTCTGTATGAGCGGAGCAGCA

TTACTCTGAAAGGAGT-------------------------GGAGCAGCA          (Δ25)      [×2]
TTACTCTGAA--------------AGAAGTTCTGTATGAGCGGAGCAGCA          (Δ14)      [×3]
TTACTCTGAAAGGAGTGGAC-----------CT-TATGAGCGGAGCAGCA          (Δ12)      [×1]
TTACTCTGAAAGGAGTGG---------AGTTCTGTATGAGCGGAGCAGCA          (Δ9)       [×1]
TTACTCTGAAAGGAGTGGACT--------TTCTGTATGAGCGGAGCAGCA          (Δ8)       [×4]
TTACTCTGAAAGGAGTG A-----AG AGTTCTGTATGAGCGGAGCAGCA          (Δ7,+2)    [×5]
TTACTCTGAAAGGAGTGGACTTTC---AGTTCTGTATGAGCGGAGCAGCA          (Δ3)       [×1]
TTACTCTGAAAGGAGTGGACTTTCtgtatgAGAAGTTCTGTATGAGCGGA          (+6)       [×2]
TTACTCTGAAAGGAGTGGACTTTCAGAAGTTCTGTATGAGCGGAGCAGCA                     [×1]
```

B
ptf1a/p48 TALEN targeted F1 embryos

```
TTCACTGACCATTCCTCTAGGGACGCCCTGGACCCAGACGACTTTTTGGA

TTCACTGACCATTCCTCTAGG---------------GACGACTTTTTGGA          (Δ15)      [×1]
TTCACTGACCATTCCTCT-----------GGACCCAGACGACTTTTTGGA          (Δ11)      [×1]
TTCACTGACCATTCCTCTA----------GGACCCAGACGACTTTTTGGA          (Δ10)      [×7]
TTCACTGACCATTCCTCTAG---------GGACCCAGACGACTTTTTGGA          (Δ9)       [×4]
TTCACTGACCATTCCTCTAGGGACGCCCTGGACCCAGACGACTTTTTGGA                     [×2]
```

*Fig. 22*

C
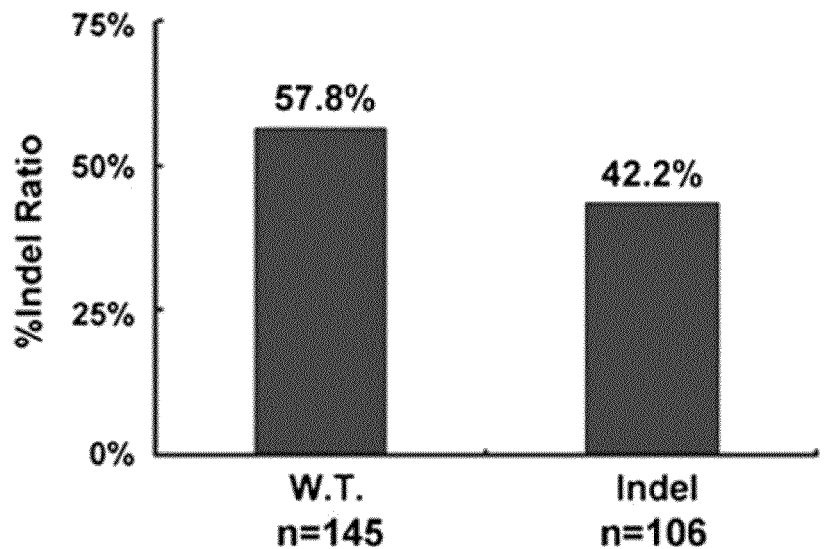
D
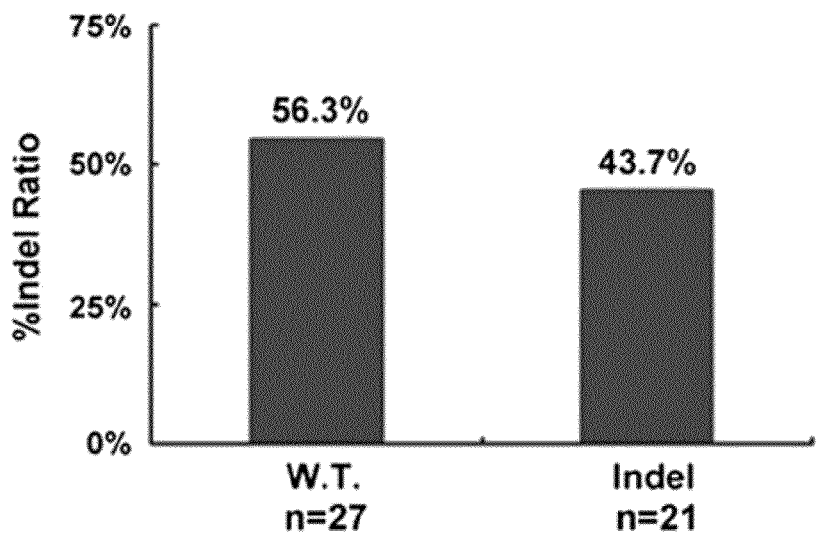
Fig. 22 (cont'd)

TRANSCRIPTION ACTIVATOR-LIKE EFFECTOR NUCLEASES (TALENS)

CROSS-REFERENCES TO RELATED APPLICATIONS

This application claims priority to U.S. Provisional Application No. 61/704,917, filed Sep. 24, 2012, the contents of which are hereby incorporated by reference in the entirety for all purposes.

REFERENCE TO A "SEQUENCE LISTING," A TABLE, OR A COMPUTER PROGRAM LISTING APPENDIX SUBMITTED AS AN ASCII TEXT FILE

The Sequence Listing written in file -109-1.TXT, created on Nov. 1, 2013, 610,304 bytes, machine format IBM-PC, MS-Windows operating system, is hereby incorporated by reference in its entirety for all purposes.

BACKGROUND OF THE INVENTION

The ability to modify the genome of an organism at a specifically targeted location is a long sought goal in the biological sciences. For example, such targeted modifications can repair genetic defects. Alternatively, genes (endogenous or heterologous) can be introduced into an organism at a pre-determined location. As yet another alternative, endogenous genes, or regulatory regions associated therewith, can be knocked out or altered. However, robust methods for such targeted genome modification have been challenging to develop.

The present invention provides a robust platform for modular assembly of customized and highly-effective nucleic acid editing tools. This platform enables rapid targeted modification of nucleic acids and genomes. The nucleic acid editing tools are based on an optimized Transcription Activator-like (TAL) effector endonuclease (TALEN) scaffold.

BRIEF SUMMARY OF THE INVENTION

Accordingly, the present invention provides compositions and methods for targeted nucleic acid modification using Transcription Activator-like (TAL) effector endonucleases (TALENs).

In one embodiment, the present invention provides an improved transcription activator like effector nuclease (TALEN), comprising from the N-terminus to the C-terminus: (i) a first segment of about 50 to about 200 amino acids in length; (ii) a TAL effector DNA-binding domain providing sequence-specific binding to a target nucleotide sequence; (iii) a second segment of about 20 to 100 amino acids in length; and (iv) a modified FokI nuclease catalytic domain.

In some embodiments, the TAL effector DNA-binding domain comprises 12-31 TAL repeats. In some cases, the TAL effector DNA-binding domain comprises a C-terminal truncated TAL repeat.

In some embodiments, the first segment contains an N-terminal portion of the coding region for a TALE from *Xanthomonas* spp. in which the Type III-dependent plant cell translocation sequence is deleted. In some cases, the first segment has the amino acid sequence of SEQ ID NO: 1.

In some embodiments, the second segment contains a truncated C-terminal domain of a *Xanthomonas* spp. TALE. In some cases, the second segment has the amino acid sequence of SEQ ID NO: 2.

In some embodiments, the modified FokI nuclease catalytic domain is an obligate heterodimer. In some cases, the obligate heterodimer is constructed according to the following rules: (i) a T nucleotide is at position 0 and an effector binding element (EBE) sequence follows this T nucleotide; (ii) the length of each EBE sequence is independently selected to bind a nucleic acid sequence of 12, 13, 14, 15, 16, 17, 18, 19, 20, 21, or 22 bp, and the spacer sequence is from 3-30 bp in length, from 12-19 bp in length, or about 16-18 bp in length. In some cases, the number of G residues in the EBE sequences are minimized, or the number of G residues in the EBE sequences is less than four. In some cases, EBEs are selected to flank at least a portion of a coding region if the target region encodes a protein or a seed region if the target region encodes an miRNA. In some cases, the spacer sequence is 16-18 bp. In some cases, the length of each EBE sequence is a length that is independently selected from 16, 17, 18, and 19 bp. In some cases, the modified FokI nuclease catalytic domain has the amino acid sequence of SEQ ID NOs:3 or 4.

In some embodiments, the present invention provides a pair of TALENs that bind to and flank a nucleic acid region of interest. In some embodiments, the present invention provides a pair of TALEN obligate heterodimers, wherein the pair of TALEN obligate heterodimers bind to and flank a nucleic acid region of interest. In some cases, the pair of TALEN obligate heterodimers bind to and flank an miRNA gene cluster.

In some embodiments, the present invention provides a library of TALENs, the library containing a plurality of TALENs pairs constructed to efficiently cleave miRNA or protein coding regions of a target organism. In some cases, the TALENs pairs are obligate heterodimers. In some cases the library of TALENs obligate heterodimers is constructed according to the following rules: (i) a T nucleotide is at position 0 and an effector binding element (EBE) sequence follows this T nucleotide; (ii) the length of each EBE sequence is independently selected to bind a nucleic acid sequence of 12, 13, 14, 15, 16, 17, 18, 19, 20, 21, or 22 bp, and the spacer sequence is from 3-30 bp in length, from 12-19 bp in length, or about 16-18 bp in length. In some cases, the number of G residues in the EBE sequences are minimized, or the number of G residues in the EBE sequences is less than four. In some cases, EBEs are selected to flank at least a portion of a coding region if the target region encodes a protein or a seed region if the target region encodes an miRNA.

In some embodiments, the present invention provides a polynucleotide sequence encoding any one of the foregoing TALENs.

In some cases, the polynucleotide is mRNA.

In some embodiments, the present invention provides an expression cassette comprising a promoter and further comprising one of the foregoing polynucleotides.

In some cases, the expression cassette further comprises a coding sequence for a nuclear localization signal (NLS) and a polyadenylation signal sequence. In some cases, the NLS in the expression cassette comprises an SV40 NLS. In some cases, the SV40 NLS comprises PKKKRKV (SEQ ID NO:649). In some cases, the polyadenylation signal sequence is the SV40 polyadenylation signal sequence. In some cases, the expression cassette is the plasmid pCS2-TALENs-ELD or pCS2-TALENs-KKR.

In some embodiments, the present invention comprises a host cell comprising any one of the preceding expression cassettes or a host cell comprising any one of the preceding polynucleotides.

In some embodiments, the present invention provides a method of producing an mRNA of the present invention, comprising providing a polynucleotide sequence encoding a TALEN of the present invention, wherein the polynucleotide sequence is DNA, under conditions permissible for mRNA transcription. In some cases, the conditions permissible for mRNA transcription comprise in vitro transcription. In some cases, the conditions permissible for mRNA transcription comprise in vivo transcription in a host cell.

In some embodiments, the present invention provides a method of cleaving a target nucleic acid sequence in the genome of a host cell, the method comprising introducing into the cell at least one pair of mRNA encoding two TALENs of the present invention, wherein: each of the two TALENs comprises a distinct TAL effector DNA-binding domain providing sequence-specific binding to a distinct predetermined nucleotide sequence located on two separate strands of the target nucleic acid sequence; and each of the two TALENs comprises a monomer of an obligate heterodimer endonuclease. In some cases, two pairs of mRNA encoding four TALENs are introduced into the cell. In some cases, the two pairs of TALENs recognize sequences that flank a nucleic acid region of interest, thereby inducing double stranded breaks in the DNA flanking the nucleic acid region of interest. In some cases, the method further comprises introducing into the cell a heterologous nucleic acid that comprises a region homologous to a sequence at or near the induced double-stranded breaks. In some cases, the heterologous nucleic acid or a portion thereof is thereby introduced into the nucleic acid region of interest.

DEFINITIONS

The term "nucleic acid" or "polynucleotide" refers to deoxyribonucleic acids (DNA) or ribonucleic acids (RNA) and polymers thereof in either single- or double-stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., *Nucleic Acid Res.* 19:5081 (1991); Ohtsuka et al., *J. Biol. Chem.* 260:2605-2608 (1985); and Rossolini et al., *Mol. Cell. Probes* 8:91-98 (1994)). The term nucleic acid is used interchangeably with gene, cDNA, and mRNA encoded by a gene.

The term "gene" means the segment of DNA involved in producing an RNA, a microRNA, or a polypeptide chain. It may include regions preceding and following the coding region (leader and trailer, e.g., 5' and 3' untranslated regions (UTRs)) as well as intervening sequences (introns) between individual coding segments (exons). Accordingly, a "target gene," or "gene of interest" refers to any nucleotide sequence encoding a known or putative gene product (e.g., encoding an RNA, a microRNA, or a protein). Similarly, "target nucleic acid" refers to any nucleotide sequence. In some cases, the target gene, gene of interest, or target nucleic acid is a nucleic acid sequence found in the genome of an organism.

A "promoter" is defined as an array of nucleic acid control sequences that directs transcription of a nucleic acid. As used herein, a promoter includes necessary nucleic acid sequences near the start site of transcription, such as, in the case of a polymerase II type promoter, a TATA element. A promoter also optionally includes distal enhancer or repressor elements, which can be located as much as several thousand base pairs from the start site of transcription.

An "expression cassette" is a nucleic acid construct, generated recombinantly or synthetically, with a series of specified nucleic acid elements that permit transcription of a particular polynucleotide sequence in a host cell. An expression cassette may be part of a plasmid, viral genome, or nucleic acid fragment. Typically, an expression cassette includes a polynucleotide to be transcribed, operably linked to a promoter.

The terms "modulate," "modulation," "modify" and the like refer to the ability of a method or composition to increase or decrease the activity and/or expression of a target gene or gene product. Modulation can occur in vitro or in vivo. Modulation, as described herein, includes the inhibition, antagonism, partial antagonism, activation, agonism or partial agonism of a function or characteristic associated with a target gene or gene product. In some cases, the modulation is direct. For example, the promoter of a target gene or an exon of the target gene can be altered by a composition or method of the present invention to reduce or increase transcription of the gene, or reduce or eliminate translation of the full-length, wild-type gene product. The ability of a composition or method of the present invention to modulate a target gene or gene product can be demonstrated in a biochemical assay, e.g., an ELISA, a microarray, SAGE, or nucleic acid amplification (RT-PCR, Q-PCR, etc.).

The term "indel" refers to an mutation in a nucleotide sequence in which a nucleotide is inserted or deleted from the wild-type sequence. Indel mutations can also insert or delete multiple nucleotides in a wild-type sequence. In some cases, the indel mutation results in a frame shift, possibly resulting in an encoded protein or RNA that is longer or shorter than the wild-type gene product. In some cases, the indel mutation results in replacement of one or more amino acids in comparison to the wild-type gene product.

In some cases, a target gene product is modified by introducing an indel mutation in or near the coding region of the target gene. For example, an indel mutation can be introduced in a promoter region, a 5' UTR region, a 3' UTR region, an exon, an intron, an enhancer or a repressor of the target gene.

As used in herein, the terms "identical" or percent "identity," in the context of describing two or more polynucleotide or amino acid sequences, refer to two or more sequences or subsequences that are the same or have a specified percentage of amino acid residues or nucleotides that are the same (for example, a core amino acid sequence responsible for binding to a target nucleic acid has at least 80% identity, preferably 85%, 90%, 91%, 92%, 93, 94%, 95%, 96%, 97%, 98%, 99%, or 100% identity, to a reference sequence, e.g., a TAL domain), when compared and aligned for maximum correspondence over a comparison window, or designated region as measured using one of the following sequence comparison algorithms or by manual alignment and visual inspection. Such sequences are then said to be "substantially identical." With regard to polynucleotide sequences, this definition also refers to the complement of a test sequence. Preferably, the amino acid identity exists over a region that is at least about 25 amino acids in length, about 33 or 34 amino acids, or about 50 amino acids or more in length. Similarly, the nucleotide sequence identity can exist over a region that is at least about 75 nucleotides in length, 99 or 102 nucleotides in length, or about 150 or more nucleotides in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. For sequence comparison of nucleic acids and proteins, the BLAST and BLAST 2.0 algorithms and the default parameters discussed below are used.

A "comparison window", as used herein, includes reference to a segment of any one of the number of contiguous positions selected from the group consisting of from about 20 to 600, about 50 to about 200, or about 100 to about 150 in which a sequence may be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman, *Proc. Nat'l. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., *Current Protocols in Molecular Biology* (Ausubel et al., eds. 1995 supplement)).

Examples of algorithms that are suitable for determining percent sequence identity and sequence similarity are the BLAST and BLAST 2.0 algorithms, which are described in Altschul et al., (1990) J. Mol. Biol. 215: 403-410 and Altschul et al. (1977) Nucleic Acids Res. 25: 3389-3402, respectively. Software for performing BLAST analyses is publicly available at the National Center for Biotechnology Information website, ncbi.nlm.nih.gov. The algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al, supra). These initial neighborhood word hits acts as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a word size (W) of 28, an expectation (E) of 10, M=1, N=−2, and a comparison of both strands. For amino acid sequences, the BLASTP program uses as defaults a word size (W) of 3, an expectation (E) of 10, and the BLOSUM62 scoring matrix (see Henikoff & Henikoff, Proc. Natl. Acad. Sci. USA 89:10915 (1989)).

The BLAST algorithm also performs a statistical analysis of the similarity between two sequences (see, e.g., Karlin & Altschul, *Proc. Nat'l. Acad. Sci. USA* 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

An indication that two nucleic acid sequences or polypeptides are substantially identical is that the polypeptide encoded by the first nucleic acid is immunologically cross reactive with the antibodies raised against the polypeptide encoded by the second nucleic acid, as described below. Thus, a polypeptide is typically substantially identical to a second polypeptide, for example, where the two peptides differ only by conservative substitutions. Another indication that two nucleic acid sequences are substantially identical is that the two molecules or their complements hybridize to each other under stringent conditions, as described below. Yet another indication that two nucleic acid sequences are substantially identical is that the same primers can be used to amplify the sequence.

"Translocation sequence" or "transduction sequence" refers to a polypeptide sequence that directs the movement of a protein from one cellular compartment to another, or from the extracellular space through the cell or plasma membrane into the cell. Examples include nuclear localization sequences (NLSs). Nuclear localization sequences can consist of short sequences of positively charged lysines, arginines, or a combination thereof that tag a protein for import into a cell nucleus. The NLS can be a classical NLS or a non-classical NLS. Classical NLSs can include monopartite or bipartite NLSs. In some cases, the classical NLS contains the consensus sequence K-K/R-X-K/R. Non-classical NLSs can include the M9 domain of hnRNP A1, a proline-tyrosine NLS, an NLS derived from yeast ribosomal proteins S22 or S25, or the KIPIK (SEQ ID NO:650) sequence from yeast Mata2. One exemplary NLS is the SV40 NLS. The NLS can be positioned in any part of a transcribed and translated gene product. For example, the NLS can be present as an N-, or C-terminal fusion. Altneratively, the NLS can be positioned in a region of the gene product that is amenable to insertion, such as in a variable length loop region.

A "nuclease" as used herein refers to an exonuclease or an endonuclease. Endonucleases are enzymes capable of hydrolyzing (cleaving) the bond between nucleotides in an RNA or DNA molecule. Endonucleases can include type IIs restriction endonucleases which recognize and bind to a DNA sequence and cleave at a site distant from the recognition site. In some cases, the type IIs restriction endonucleases recognize a four to seven base pair long sequence and cleave the DNA 10-18 bases 3' of the recognition sequence. Exemplary type IIs restriction endonucleases can include but are not limited to AciI, AcuI, AlwI, BbvI, BccI, BceAI, BciVI, BfuAI, BmgBI, BmrI, BpmI, BpuEI, BsaI, BsmAI, BsmFI, BseRI, BspCNI, BsrI, BsgI, BsmI, BspMI, BsrBI, BsrDI, BtgZI, BtsI, BtsCI, EarI, EciI, FokI, HgaI, HphI, HpyAV, MboII, MlyI, MmeI, MnlI, NmeAIII, PleI, SfaNI, BbvCI, Bpu10I, BspQI, SapI, BaeI, BsaXI, or CspCI. Endonucleases can be employed in methods for fast in vitro assembly of TALEN vectors and expression cassettes. Endonucleases can also be part of a Transcription Activator-like (TAL) effector endonuclease (TALEN).

As used herein, "TALEN" refers to a nucleic acid encoding a protein, or the protein itself, that contains a TAL effector DNA-binding domain fused to an endonuclease. TAL effector DNA-binding domains are derived from transcription activator-like effectors (TALEs), a class of proteins commonly found in *Xanthomonas* that bind to specific DNA sequences and activate expression of target genes. TAL effector DNA-binding domains contain highly conserved repeated 33 or 34 amino acid length sequences, referred to as TAL repeats. Each TAL repeat contains highly variable $12^{th}$ and $13^{th}$ amino acids, referred to as the repeat variable diresidues (RVDs). The RVDs in a TAL repeat specifically recognizes a corresponding nucleotide of a target sequence. Thus, recognition of a specific nucleotide sequence can be achieved by selecting a combination of TAL repeats containing the appropriate RVDs to form a specific TAL effector DNA-binding domain. A TALEN consisting of a TAL effector DNA-binding domain and an endonuclease can bind to a recognition sequence of a nucleic acid and cleave the nucleic acid.

In some cases, the endonuclease is engineered as an obligate dimer. For example, the endonuclease can be engineered as an obligate heterodimer. In such cases, a pair of TALENS each containing one member of the obligate heterodimer pair must bind to adjacent (e.g., within about 10, 11, 12, 13, 14, 15, 16, 17, 18, 19, 20, 21, 22, 23, 24, or about 25 nucleotides) recognition half-sites (known as effector binding elements, or EBEs) to enable dimerization of the endonuclease for cleavage to occur. In some cases, each EBE of an obligate heterodimer pair can independently be about 9, 10, 11, 12, 13, 14, 15, 16, 17, 18, 19, 20, 21, 22, 23, 24, 25, 26, 27, 28, or about 29 bp in length. In some cases, one monomer of an obligate dimer pair recognizes one strand of a target double-stranded nucleic acid, and the other monomer of an obligate dimer pair recognizes the other strand of a target double-stranded nucleic acid. Generally, the EBEs are separated by a spacer element where the DNA cleavage occurs. Exemplary spacer element lengths include spacer lengths of about 3, 4, 5, 6, 7, 8, 9, 10, 11, 12, 13, 14, 15, 16, 17, 18, 19, 20, 21, 22, 23, 24, 25, 26, 27, 28, 29, or 30 continuous nucleotides. Exemplary obligate heterodimer endonucleases for use in a TALEN include the ELD and KKR FokI variants described by Doyon Y, et al. (2011).

BRIEF DESCRIPTION OF THE DRAWINGS

FIG. 1: depicts optimized TALENs expression vectors. The vector backbone is based on the pCS2-Flag-TTGZFP-FokI-DD plasmid. The TALENs scaffold is modified from pTAL1 vector by truncation of the N-terminal and C-terminal fragment of TAL effectors. Black triangles, endonuclease recognition sites; SP6, SP6 promoter; NLS, nuclear localization signal; SV40, SV40 polyadenlation signal sequence; ΔN152-Esp3I-C63, TALENs scaffold with truncation of the N-terminal 152-aa and retention of C-terminal 63-aa, containing two Esp3I sites where TALE repeats could be inserted.

FIG. 3: depicts results from disruption of zebrafish gria3a and tnikb loci by TALENs. (a) Frequency and spectrum of TALENs induced gria3a mutations (WT=SEQ ID NO:133; mutations=SEQ ID NOS:134-158). (b) Frequency and spectrum of TALENs induced tnikb mutations (WT=SEQ ID NO:159; mutations=SEQ ID NOS:160-171). The TALENs binding sites are shown in shaded background. Deletions are indicated by dash lines and insertions are indicated by lowercase letters. The number of times each mutant allele appearing is shown on the right side of the mutant allele.

FIG. 5: illustrates the results of disruption of zebrafish miR-214 by TALENs. (a) Frequency and spectrum of TALENs induced mutations (WT=SEQ ID NO:269; mutations=SEQ ID NOS:270-281). The TALENs binding sites are shown in shaded background. DNA sequence encoding mature miR-214 is underlined, with the miR-214 seed sequence in bold. Deletions are indicated by dash lines and insertions are indicated by lowercase letters. The number of times each mutant allele appearing is shown on the right side of the mutant allele. (b) Disruption of the hairpin structure of pre-miRNA mutant. Upper panel, the hairpin structure of the wild type pre-miR-214 (SEQ ID NO:282); lower panel, the hairpin structure of the most frequently sequenced pre-miR-214 mutant in (a) (SEQ ID NO:283).

FIG. 8: depicts the mutation frequency and spectrum of each locus targeted by miR-17-92 TALENs. Mir-17-92N1 WT=SEQ ID NO:344; mutations=SEQ ID NOS:345-347. Mir-17-92N2 WT=SEQ ID NO:348; mutations=SEQ ID NOS:349-351. Mir-17-92C1 WT=SEQ ID NO:352; mutations=SEQ ID NOS:353-362. Mir-17-92C2 WT=SEQ ID NO:363; mutations=SEQ ID NOS:364-366. The TALENs binding sites are shown in shaded background. Deletions are indicated by dash lines and insertions are indicated by lowercase letters. The number of times each mutant allele appearing is shown on the right side of the mutant allele.

FIG. 10: depicts the mutation frequency and spectrum of each locus targeted by miR-430 TALENs. Mir-430N1 WT=SEQ ID NO:404; mutations=SEQ ID NOS:405-411. Mir-430N2 WT=SEQ ID NO:412; mutations=SEQ ID NOS: 413-424. Mir-430C1 WT=SEQ ID NO:425; mutations=SEQ ID NOS:426-429. Mir-430C2 WT=SEQ ID NO:430; mutations=SEQ ID NOS:431-441. The TALENs binding sites are shown in shaded background. Deletions are indicated by dash lines and insertions are indicated by lowercase letters. The number of times each mutant allele appearing is shown on the right side of the mutant allele.

FIG. 11: illustrates sequencing confirmation of miR-430 cluster deletion. Mir-430N1C1 mutations=SEQ ID NOS: 442-446. Mir-430N2C1 mutations=SEQ ID NOS:447-451. Mir-430N1C2 mutations=SEQ ID NOS: 452-456. Mir-430N2C2 mutations=SEQ ID NOS: 457-461. Sequencing results are obtained from the pooled embryos microinjected with the cocktail TALENs. The TALENs binding sites are color-coded: underlined, N1 left site; bold, N2 left site; boxed, C1 right site; dashed underline, C2 right site. Lowercase letters indicate nucleotide sequences between the binding sites.

FIG. 13: Modification of Golden Gate TALEN vectors. The pTAL1 (plasmid no. 31031; Addgene) vector in Golden Gate Kits was replaced by modified pCS2+TALEN-ELD/KKR vector for overexpression in *Xenopus* embryos. The KpnI site at 1,256 in pTAL1 was blocked by point mutation. The sequence between 5'-GTGGATCTACGCACGCTCGG-3' (SEQ ID NO:651) and 5'-GCACGTCCCATCGCGTTGCC-3' (SEQ ID NO:652) [covering the region from the amino acid 153 in the N-terminal domain to amino acid 63 in the C-terminal domain (1)] was subcloned into pCS2-Flag-TTGZFP-Fok I-DD vector (plasmid no. 18755; Addgene) by using KpnI and BamHI. The coding sequences of heterodimeric ELD/KKR-Fok I domains were separately inserted into the pCS2-Flag-TTGZFP-Fok I-DD vector to replace the former Fok I-DD domains by using BamHI and XbaI. The Esp3I cleavage site in Fok I domain was then also blocked. These modified pCS2-Flag-TALEN-ELD/KKR (pCS2+TALEN-ELD/KKR for short) vectors were used in Golden Gate Assembly, and the TALEN assembly protocol is in principle following Cermak, et al. (2011). Endonuclease sites marked by star were blocked during construction. Not drawn to scale.

FIG. 16: The TALEN-targeted sequences of noggin (SEQ ID NO:555), and ptf1a/p48 (SEQ ID NO:556) in the *X. tropicalis* genome, and ets1 (SEQ ID NO:557) loci in the *X. laevis* genome. DNA sequences highlighted in light gray are exons, and the plain text indicates introns. The sequences underlined are primers for colony PCR. The DNA sequences highlighted in darker gray are TALEN EBEs. The DNA sequences enclosed by thin lines are ZFN-targeted sites. The ets1a cDNA sequence from *X. laevis* showing the TALEN target site is also included. The GenBank accession numbers are listed as following: *X. tropicalis* noggin, NM_001171898.1; ptf1a/p48, XM_002933135.1; ets1, NM_001130368.1; and *X. laevis* ets1a, NM_001087613.1.

FIG. 18: DNA sequences of hhex, vpp1, foxd3, sox9, and grp78/bip mutations, gene disruption frequencies, and phenotypes of TALEN-injected *X. tropicalis* embryos. TALEN mRNAs (500 pg) targeting hhex, vpp1, foxd3, sox9, or grp78/bip were injected into one-cell stage embryos, and phenotypes were recorded at 48 h postfertilization. Mutagenesis detection was performed as in FIG. 14. (A) Mutation frequencies. (B) Phenotypes induced by the corresponding TALENs. (C) Shaded wild-type sequences (SEQ ID NOS:558, 575, 590, 601 and 604, respectively) indicate the 16-bp EBEs. Mutations (SEQ ID NOS:559-574, 576-589, 591-600, 602-608 and 610-615, respectively) are shaded in gray. Dashes indicate deletions (Δ) and lowercase letters indicate insertions (+). The numbers in parentheses indicate the deleted or inserted base pairs. The numbers in square brackets showed the frequencies of the mutation.

FIG. 19: The TALEN-targeted sequences of hhex (SEQ ID NO:616), vpp1 (SEQ ID NO:617), sox9 (SEQ ID NO:618), foxd3 (SEQ ID NO:619), and grp78/bip (SEQ ID NO:620) in the *X. tropicalis* genome. DNA sequences in bold are exons and the plain text indicates introns. The underlined sequences are primers for colony PCR, and shaded sequences are TALEN EBEs. The GenBank accession numbers are listed as follows: hhex, NM_204089.1; vpp1, XM_002941849.1; sox9, NM_001016853.2; foxd3, NM_001011383.1; and grp78/bip, XM_002941644.1.

FIG. 20: Potential off-target sites of the TALENs used here identified by e-PCR in the *X. tropicalis* genome. The e-PCR program, downloaded from the National Center for Biotechnology Information website (www.ncbi.nlm.nih.gov/sutils/e-per), was used to identify potential off-target sites. The criteria were up to six mismatches in two EBEs, 2-bp gaps in the two EBEs, and <1,000 bp between the two putative off-target sites. In total, 10 potential off-target sites were identified for the noggin-TALENs, 2 for ptf1a/p48-TALENs, and 20 for ets1-TALENs. The hits in light gray text are the EBEs used in this study. The sites highlighted by shading, in which the spacer region is <100 bp, were amplified and sequenced. No mutations were found at these sites.

FIG. 22: Sequence and frequency of mutant alleles inherited in $F_1$ embryos. (A and B) DNA sequencing confirmed germ-line (SEQ ID NOS:636 and 621) transmission of ets1 and ptf1a/p48 mutants (SEQ ID NOS:637-644, 636 and 645-648 and 621, respectively) induced by the TALENs. Disrupted sequences are shaded in gray. Dashes indicate deletions (Δ). The numbers of deleted base pairs are shown in parentheses, and the number of embryos showing the particular mutation is given in square brackets. (C and D) The percentage of wild-type and the TALENdisrupted alleles in $F_1$ embryos derived from ets1- or ptf1a/p48-TALEN-targeted frogs, determined either by colony PCR (ets1-TALEN-targeted $F_1$ embryos) or DNA sequencing (ptf1a/p48-TALEN-targeted $F_1$ embryos). Twenty $F_1$ embryos for ets1 from three crosses and 15 $F_1$ embryos for ptf1a/p48 from two crosses of $G_0$ by wild type were examined. The n in C and D indicates the number of bacterial clones that were examined after TA cloning.

DETAILED DESCRIPTION OF THE INVENTION

I. Introduction

Figure 2:
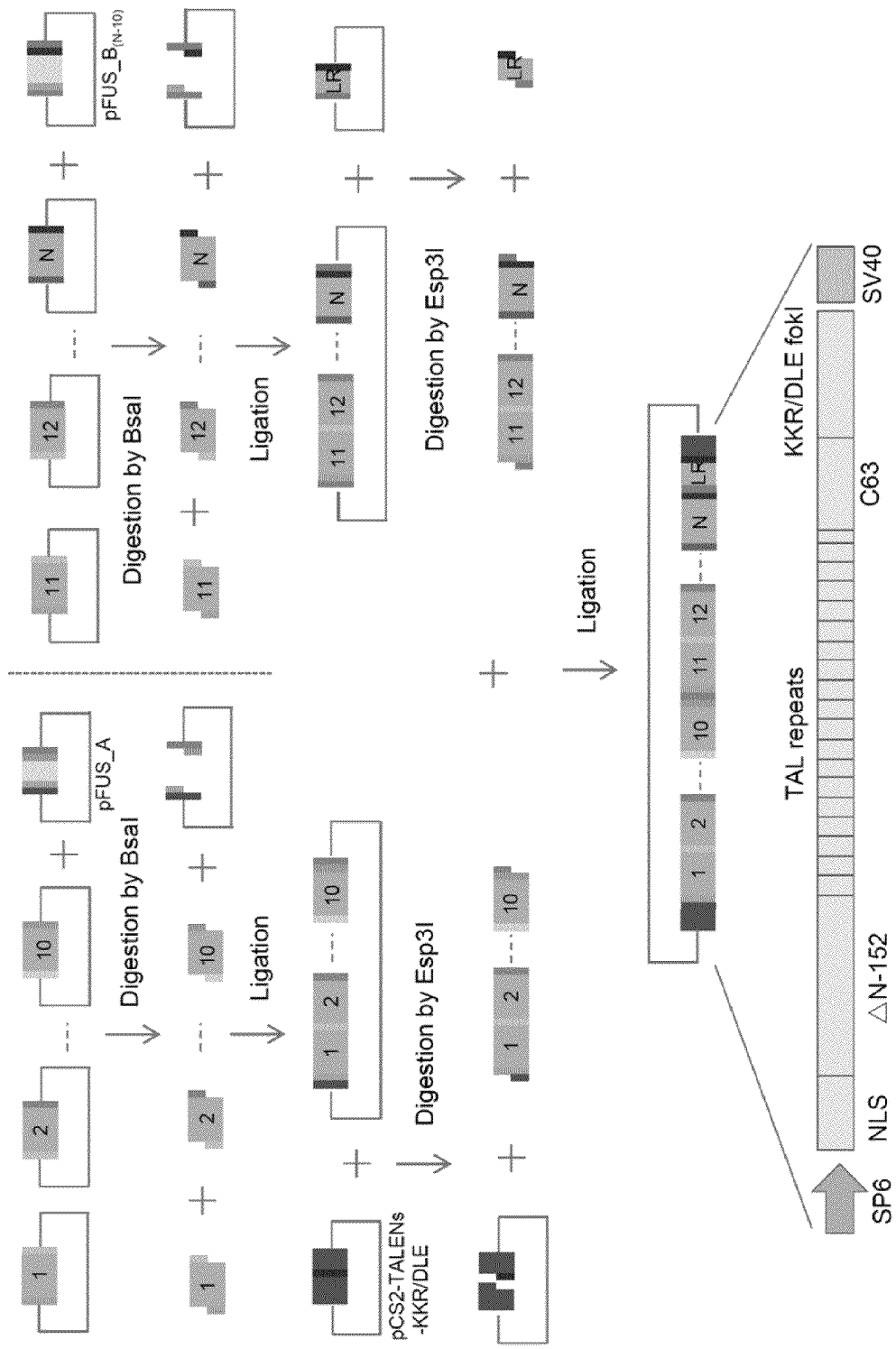
FIG. 2: depicts Golden-gate assembly of customized TALENs. Assembly of customized TALENs (RDV=12-21) using two digestion-ligation steps. After digestion by type II endonucleases BsaI or Esp3I, each plasmid generates 4-bp complementary overhangs (color-coded) and can be ligated together in a serial order. The first step is to ligate the TAL repeat recognizing each target base (except the last base) into the array plasmids. The 10 modular plasmids recognizing the first 1 to 10 target DNA base are digested and ligated into the array vector pFUS_A. The modular plasmids recognizing the 11 to N (N=13, 14, 15, 16, 17, 18, 19 or 20) target DNA base are digested and ligated into the array vector pFUS_B (N-10). The second step is to ligate the TAL repeats in the pFUS_A, pFUS_B (N-10) and the last TAL repeat into TALENs expression vector pCS2-TALENs-DLE or pCS2-TALENs-KKR. For assembly of TALENs with 22-31 RDVs, please refer to reference 19. SP6, SP6 promoter; NLS, nuclear localization signal; SV40, SV40 polyadenlation signal sequence; LR, last repeat; ΔN152, truncation of the N-terminal 152-aa; C63, retention of C-terminal 63-aa in TALENs scaffold.

Transcription activator-like effector nucleases (TALENs) are artificial endonucleases generated by fusing a TAL effector DNA binding domain to a DNA cleavage domain. The TAL effector DNA binding domain consists of a series of TAL repeats. The TAL repeats are highly conserved 33 or 34 amino acid sequence segments that each contain a highly variable $12^{th}$ and $13^{th}$ amino acid known as the repeat variable diresidue (RVD). Each RVD recognizes and binds to a specific nucleotide. Thus, a TAL effector binding domain can be engineered to recognize a specific sequence of nucleotides by combining TAL repeats containing the appropriate RVDs. The following RVDs recognize the following nucleotides: HD recognizes C, NG recognizes T, NI recognizes A, NN recognizes G or A, NS recognizes A or C or G, HG recognizes T, and IG recognizes T. Other RVDs and their corresponding recognized nucleotide are known in the art.

TALENS can be utilized to perform a variety of genome editing functions. For example, a TALEN, or pair of obligate dimer TALENS, can be designed to cut a target nucleic acid and thus reduce or prevent transcription of a targeted gene. As another example, a TALEN, or pair of obligate dimer TALENS, can be designed to cut a region of nucleic acid encoding for a repressor of a gene and thus inactivate the repressor and indirectly activate the gene of interest.

As yet another example, a pair of TALENs, or two pairs of obligate dimer TALENs, each pair recognizing a pair of sequences that flank a region of interest, can be used to create double stranded breaks flanking the region of interest. The region of interest can then be repaired by endogenous non-homologous end joining mechanisms. Thus, the region of interest will be deleted or significantly altered by the introduction of one or more indel mutations. In this way, a gene or a portion of a gene can be removed from the genome of a cell or inactivated. Alternatively, the region of interest can be repaired by homologous repair mechanisms. Thus, in some cases, TALENs can be used to reduce heterozygosity at a specific locus in a cell. As yet another alternative, a cell can also be contacted with a heterologous nucleic acid with homology to the region in which the double stranded breaks are introduced. In such cases, the region of interest can be replaced by the heterologous nucleic acid or a portion thereof by endogenous homologous repair mechanisms.

II. Compositions

Described herein are TALENs for cleaving a target nucleic acid. An exemplary TALEN has a first segment of about 50 to about 200 amino acids in length. The first segment can be derived from the N-terminal region of a TALE protein, such as the N-terminal region of a *Xanthomonas* TALE. For example, the first segment can be derived from the *Xanthomonas* TALEN encoded by the pTAL1 vector (Cermak, et al., 2011; addgene plasmid 31031). In some cases, the first segment can correspond to the first 288 amino acids of the TALEN encoded by the pTAL1 vector. As another example, the first segment can be derived from the N-terminal portion of the TALE pthXo1, or tal1c. In some cases, the Type III-dependent plant cell translocation sequence of the TALE or TALEN is deleted. In some cases, at least about 50, 55, 60, 65, 70, 75, 80, 85, 90, 95, 100, 105, 110, 115, 120, 125, 130, 135, 140, 145, 150, 155, 160, 165 or more continuous amino acids are deleted from the N-terminus of the TALE or TALEN as compared to the TALEN of pTAL1, or as compared to pthXo1 or tal1c. In some cases, the first 152 amino acids of the N-terminus are deleted from the first segment. An exemplary first segment in which 152 amino acids have been deleted from the N-terminus is provided as SEQ ID NO: 1.

The first segment can further include, or be fused to, additional functional sequences. For example, the first segment can include, or be fused to, a nuclear localization signal (NLS). As another example, the first segment can include or be fused to one or more purification or detection tags, such as a FLAG tag, or a myc tag. Additional purification or detection tags suitable for inclusion at the N-terminus are well-known in the art.

TALENs described herein can further include a TAL effector DNA-binding domain that provides sequence-specific binding to a target nucleotide sequence. TAL effector DNA-binding domains consist of a series of highly conserved repeated segments (referred to as TAL repeats), each of which can be about 33 to about 34 amino acids in length. The TAL repeats can contain two amino acids at the $12^{th}$ and $13^{th}$ positions that encode DNA binding specificity. The TAL effector DNA-binding domain can include 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, or more TAL repeats. Thus, the TAL effector DNA-binding domain can specifically recognize and bind to a nucleic acid sequence consisting of at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, or more continuous nucleotides. Exemplary TAL effector DNA-binding domain sequences are provided in SEQ ID NOs:7-59.

TALENs provided herein can further include a C-terminal truncated TAL repeat in the TAL effector DNA binding domain. The C-terminal truncated TAL repeat is homologous to the full-length 33-34 amino acid long TAL repeats of the TAL effector DNA-binding domain, but is truncated to about 20 or fewer amino acids (e.g., is about 34, 33, 32, 31, 30, 29, 28, 27, 26, 25, 24, 23, 22, 21, 20, 19, 18, 17, 16, 15, 14, 13, or 12 amino acids in length or less). Additionally, the C-terminal truncated TAL repeat contains RVDs that provide specificity for a nucleotide as described above.

TALENs provided herein can further include a second segment comprising a C-terminal TALE domain. For example, the TALENs can include a second segment that contains about the last 60, 65, 70, 80, 85, 90, 95, 100, 105, 110, 115, 120, 125, 130, 135, 140, 145, 150, 155, 160, 165, 170, 180, 190, or 200 amino acids or more of a *Xanthomonas* TALE protein. As another example, the TALEN can include a second segment that contains the C-terminal 152 amino acids of a TALE protein as found in the pTAL1 vector (Cermak, et al., 2011; addgene plasmid 31031). In some cases, the C-terminal domain is truncated. In some cases, the truncation removes amino acids from the C-terminus of the C-terminal domain. In other cases, the truncation removes amino acids from the N-terminus of the C-terminal domain. For example, the truncation of the C-terminal domain can remove about 2, 3, 4, 5, 6, 7, 8, 9, 10, 12, 14, 16, 18, 20, 23, 25, 27, 30, 33, 36, 39, 42, 46, 50, 55, 60, 65, 70, 75, 80, 85, 89, 90, 95, 100, 105, 110, 115, 120, or more amino acids from the N—, or C-terminus. The C-terminal domain can further include one or more nuclear localization sequences (NLSs). The C-terminal domain can also include one or more purification or detection tags such as a FLAG tag or a myc-tag.

Natural TALE, DNA binding sites almost always contain a T at position 0 (Moscou, M. J., et al., 2009; Boch, J., et al., 2009). Thus, in some embodiments, TALEN binding sites can be chosen such that position 0 is T, and TAL effector DNA-binding sites can be assembled that recognize and bind to nucleic acid sequences that are immediately 3' of a T. In some cases, TAL effector DNA-binding sites are assembled to recognize 16-19 bp nucleic acid sequences (e.g., recognize 9, 10, 11, 12, 13, 14, 15, 16, 17, 18, 19, 20, 21, 22, 23, 24, 25, 26, 27, 28, 29, or 30 bp length nucleic acid sequences). In some cases, when obligate dimer TALENs are utilized, TAL effector DNA-binding sites are assembled such that the spacer region between binding sites of each member of the TALEN pair is around 16-18 bp long (e.g., the spacer region is about 9, 10, 11, 12, 13, 14, 15, 16, 17, 18, 19, 20, 21, 22, 23, 24, 25, 26, 27, 28, 29, or 30 bp in length). In some cases, TAL effector DNA-binding sites are assembled such that nucleic acid recognition sequence contains less than four guanosine residues.

TALENs provided herein further include a catalytic domain. Binding of the TAL effector DNA-binding domain to a target sequence allows the catalytic domain to act on the nucleic acid containing the target sequence at or near the target sequence. For example, binding of the TAL effector DNA-binding domain can allow the catalytic domain to alter the nucleic acid within the target sequence, or within 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 or more nucleotides of the target sequence. The catalytic domain can be any type of nucleic acid modifying enzyme, such as a nuclease (e.g., an exonuclease or an endonuclease), a methylase, a demethylase, an DNA-glycosylase, an AP-lyase, a recombinase, a polymerase, a gyrase, a topoisomerase, a ligase, an integrase, a transposase, a phosphatase, or a DNA kinase.

In some embodiments, the catalytic domain is an endonuclease. In some cases, the endonuclease is relatively non-specific in that it recognizes and cleaves a variety of nucleic acid sequences. Such endonucleases can be preferred when the substrate specificity of the TALEN is sufficient to define the target nucleic acid. In such cases, a relatively non-specific endonuclease allows one of skill in the art to design the TALEN to bind and cleave a target site without undue constraint from the substrate specificity of the catalytic domain. Off-target cleavage due to the non-specificity of the endonuclease can be minimized through the use of obligate heterodimer endonucleases as described below.

In some cases, the endonuclease recognizes and cleaves at or near nucleic acid sequence recognition sites of about 4 nucleotides (e.g., about 1, 2, 3, 4, or 5 nucleotides) in length. Endonucleases that cleave nucleic acid sequences of about 4 nucleotides in length are less likely to cleave off-target nucleic acid sequences than non-specific endonucleases when used as a TALEN catalytic domain. However, such endonucleases can still allow one of skill in the art to design the TALEN to bind and cleave a target site without undue constraint from the substrate specificity of the catalytic domain. Off-target cleavage due to the non-specificity of the endonuclease can be further minimized through the use of obligate heterodimer endonucleases as described below.

In some cases, the endonuclease recognizes and cleaves at or near nucleic acid sequence recognition sites of greater than about 4 nucleotides (e.g., about 6, 7, 8, 9, 10, 11, 12, or more nucleotides) in length. TALENs that include such endonucleases are likely to exhibit strong substrate specificity, and thus off-target cleavage is less likely. In some cases, such endonucleases can be used to generate monomeric, catalytically active TALENs that do not require binding of another TALEN at an adjacent nucleic acid recognition site and dimerization of endonuclease catalytic domains to cleave the substrate DNA. For example, a single chain variant of FokI in which two FokI monomers are expressed as a polypeptide can be used in the TALEN catalytic domain. Alternatively, the TALEN can contain one monomer of an obligate dimer endonuclease in trans with the TAL effector DNA-binding domain, and the other monomer can be provided in cis. As yet another alternative, TALENs with extremely high substrate specificity can be generated by preparing TALENs with obligate heterodimer endonucleases that recognize and cleave sequences of greater than about 4 nucleotides in length.

In some cases, the TALENs contain an endonuclease catalytic domain that is a type IIs endonuclease. Type IIs endonucleases cleave DNA at a defined distance from a non-palindromic asymmetric recognition site. Thus, a type IIs endonuclease TALEN catalytic domain can provide enhanced substrate specificity in addition to the specificity provided by the TAL effector DNA-binding domain, while also cleaving any target sequence that is a defined distance from the TALEN recognition site. An exemplary type IIs endonuclease suitable for use as a TALEN catalytic domain is FokI.

In some cases, the TALEN catalytic domain endonuclease is an obligate dimer or an obligate heterodimer. In some cases, the obligate dimer or obligate heterodimer does not substantially exist in the dimer form when the TALEN is in solution. For example, in some cases, the obligate dimer or heterodimer can exist as greater than 90%, 95%, 99%, or more monomer when the TALEN it is not bound to its target nucleic acid recognition site. In some cases, the obligate dimer or obligate heterodimer dimerizes, and thus becomes catalytically competent, when two TALENs bind to adjacent nucleic acid recognition half-sites (e.g., recognition sites that are within about 5, 6, 7, 8, 9, 10, 11, 12, 13, 14, 15, 16, 17, 18, 19, 20, 21, 22, 23, 24, or 25 nucleotides). Exemplary obligate heterodimer endonucleases are FokI KKR (SEQ ID NO:3) and FokI ELD (SEQ ID NO: 4) described by Doyon, et al. 2011.

In some embodiments, a pair of TALENs, or a pair of TALEN heterodimers, are provided that recognize and bind to nucleic acid binding sequences that flank a region of interest. The pair of TALENs or pair of TALEN heterodimers can cause double stranded breaks that flank the region of interest. NHEJ or homologous repair mechanisms can then delete a substantial portion of the region of interest. In some cases, a heterologous nucleic acid is also introduced into the cell and homologous recombination between the heterologous nucleic acid and the region of interest leads to incorporation of at least a portion of the heterologous nucleic acid into the region of interest that is flanked by double stranded breaks. Methods for making and using pairs of TALENs, or pairs of TALEN dimers, are described below.

In some embodiments, polynucleotides or polynucleotide sequences encoding TALENs are provided. In some cases, the polynucleotides are optimized for expression (e.g., transcription and/or translation) in a particular host. In some cases, the polynucleotide sequences are optimized for transcription in one host, such as *E. coli*, and translation in a different host, e.g., a fish, a frog, a plant, or a mammal, such as a mouse, rat, human, etc., or a cell derived therefrom. In some cases, the polynucleotide sequences are optimized for in vitro transcription in a cell lysate from one host cell and optimized for translation in another. For example, the polynucleotides can be optimized for in vitro transcription in *E. coli* extract, wheat germ extract, or rabbit reticulocyte lysate. In some cases, polynucleotides that are optimized for translation in a particular host are codon optimized. Methods for codon optimization are well-known in the art.

In some cases, mRNAs encoding TALENs are provided. For example, mRNA encoding any of the TALENs described above can be provided. Such mRNA can be obtained by in vitro or in vivo transcription. The mRNA can be useful for translation into TALENs in a host cell. For example, the mRNA can be administered to a host cell by injection, by polyethylenimine, lipid, or calcium phosphate-mediated transfection, or by electroporation. Alternatively, the mRNA can be fused to a translocation domain that facilitates translocation across the cell membrane. Once administered to the cell, the mRNA can initiate TALEN synthesis.

In some embodiments, the present invention provides an expression cassette for production of TALENs. The expression cassette can contain a promoter operably linked to a polynucleotide encoding a TALEN. In some cases, the expression cassette is adapted for expression in a particular host. For example, the expression cassette can contain one or more eukaryotic or prokaryotic promoters. If the expression cassette contains a prokaryotic promoter, it can be adapted for expression in a prokaryotic host. Alternatively, if the expression cassette contains a eukaryotic promoter, it is adapted for expression in a eukaryotic host. In some cases, the expression cassette can contain both prokaryotic or eukaryotic promoters. The expression cassette can further contain enhancer elements, polyadenylation signals, and other elements to provide TALEN expression in a particular host.

In some cases, the expression cassette further comprises a coding sequence for a polypeptide fused to the TALEN. For example, the expression cassette can encode one or more nuclear localization signals fused to the N- or C-terminus of the TALEN. As another example, the expression cassette can encode a detection or purification tag, e.g., a FLAG or myc-tag, fused to the N- or C-terminus of the TALEN. Exemplary expression cassettes include pCS2-TALENs-ELD and pCS2-TALENs-KKR.

The present invention also provides host cells containing a TALEN expression cassette, a TALEN polynucleotide, or a TALEN. Any host cell can be utilized. For example, cells derived from any organism are suitable for use as a host cell for a TALEN expression cassette, a TALEN polynucleotide, or a TALEN.

In particular, the polynucleotides, expression cassettes, and polypeptides described herein can be introduced into a number of monocotyledonous and dicotyledonous plants or plant cells, including dicots such as safflower, alfalfa, soybean, coffee, amaranth, rapeseed (high erucic acid and canola), peanut or sunflower, as well as monocots such as oil palm, sugarcane, banana, sudangrass, corn, wheat, rye, barley, oat, rice, millet, or sorghum. Also suitable are gymnosperms such as fir and pine.

Additionally, the compositions described herein can be utilized with dicotyledonous plants belonging, for example, to the orders Magniolales, Illiciales, Laurales, Piperales, Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violates, Salicales, Capparales, Ericales, Diapensales, Ebenales, Primulales, Rosales, Fabales, Podostemales, Haloragales, Myrtales, Cornales, Proteales, Santales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales, or cells derived therefrom.

The compositions described herein can be utilized with dicotyledonous plants belonging, for example, to the orders Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchidales, or with plants belonging to Gymnospermae, e.g., Pinales, Ginkgoales, Cycadales and Gnetales, or cells derived therefrom.

The compositions described herein be used with a broad range of plant species, including species from the dicot genera *Atropa, Alseodaphne, Anacardium, Arachis, Beilschmiedia, Brassica, Carthamus, Cocculus, Croton, Cucumis, Citrus, Citrullus, Capsicum, Catharanthus, Cocos, Coffea, Cucurbita, Daucus, Duguetia, Eschscholzia, Ficus, Fragaria, Glaucium, Glycine, Gossypium, Helianthus, Hevea, Hyoscyamus, Lactuca, Landolphia, Linum, Litsea, Lycopersicon, Lupinus, Manihot, Majorana, Malus, Medicago, Nicotiana, Olea, Parthenium, Papaver, Persea, Phaseolus, Pistacia, Pisum, Pyrus, Prunus, Raphanus, Ricinus, Senecio, Sinomenium, Stephania, Sinapis, Solanum, Theobroma, Trifolium, Trigonella, Vicia, Vinca, Vitis*, and *Vigna*; the monocot genera *Allium, Andropogon, Aragrostis, Asparagus, Avena, Cynodon, Elaeis, Festuca, Festulolium, Heterocallis, Hordeum, Lemna, Lolium, Musa, Oryza, Panicum, Pannesetum, Phleum, Poa, Secale, Sorghum, Triticum*, and *Zea*; or the gymnosperm genera *Abies, Cunninghamia, Picea, Pinus*, and *Pseudotsuga*, or cells derived therefrom.

More preferably, the plant, or plant cell, can be of the species *Arabidopsis thaliana, Nicotiana tabaccum, Solanum lycopersicum, Solanum tuberosum, Solanum melongena, Solanum esculentum, Lactuca sativa, Brassica napus, Brassica oleracea, Brassica rapa, Oryza glaberrima, Oryza sativa, Asparagus officinalis, Pisum sativum, Medicago sativa, Zea mays, Hordeum vulgare, Secale cereal, Triticum aestivum, Triticum durum, Capsicum sativus, Cucurbita pepo, Citrullus lanatus, Cucumis melo, Citrus aurantifolia, Citrus maxima, Citrus medica*, or *Citrus reticulata*.

The compositions described herein be used with a broad range of fungi, or cells derived therefrom. For example, the fungus can be of the genus *Aspergillus, Penicillium, Acremonium, Trichoderma, Chrysoporium, Mortierella, Kluyveromyces* or *Pichia*. More preferably, the fungus can be of the species *Aspergillus niger, Aspergillus nidulans, Aspergillus oryzae, Aspergillus terreus, Penicillium chrysogenum, Penicillium citrinum, Acremonium Chrysogenum, Trichoderma reesei, Mortierella alpine, Chrysosporium lucknowense, Kluyveromyces lactis, Pichia pastoris* or *Pichia ciferrii*.

The compositions described herein be used with a broad range of animals or animal cells. For example, the animal cells can be of the genus *Homo, Rattus, Mus, Sus, Bos, Danio, Canis, Felis, Equus, Salmo, Oncorhynchus, Gallus, Meleagris, Drosophila*, or *Caenorhabditis*; more preferably, the animal cell can be of the species *Homo sapiens, Rattus norvegicus, Mus musculus, Sus scrofa, Bos taurus, Danio rerio, Canis lupus, Felis catus, Equus caballus, Oncorhynchus mykiss, Gallus gallus*, or *Meleagris gallopavo*; the animal cell can be a fish cell from *Salmo salar*, a Teleost fish, or a zebrafish species as non-limiting examples. The animal cell also can be an insect cell from *Drosophila melanogaster* as a non-limiting example; the animal cell can also be a worm cell from *Caenorhabditis elegans* as a non-limiting example.

In the present document, the cell can be a plant cell, a mammalian cell, a fish cell, an insect cell or cell lines derived from these organisms for in vitro cultures or primary cells taken directly from living tissue and established for in vitro culture. As non-limiting examples cell lines can be selected from the group consisting of CHO-K1 cells; HEK293 cells; Caco2 cells; U2-OS cells; NIH 3T3 cells; NSO cells; SP2 cells; CHO-S cells; DG44 cells; K-562 cells, U-937 cells; MRC5 cells; IMR90 cells; Jurkat cells; HepG2 cells; HeLa cells; HT-1080 cells; HCT-116 cells; Hu-h7 cells; Huvec cells; and Molt 4 cells.

III. Methods

In some embodiments, recombinant DNA vectors containing polynucleotide sequences encoding TALENs suitable for transformation of a host cell are prepared. In some cases, the recombinant DNA vectors are prepared using the Golden Gate cloning technique described, e.g., in Cermak, et al., 2011, and Lei, et al., 2012. Briefly, a target nucleic acid cleavage sequence is identified and plasmids containing the corresponding TAL repeats for binding a sequence adjacent to the cleavage site are provided. Up to 10 modular plasmids encoding TAL repeats for binding to the first 10 target binding sequence nucleotides are digested and ligated into an array vector. Up to 10 additional modular plasmids encoding TAL repeats for binding to the remaining target binding sequence nucleotides are digested and ligated into a second array vector. The TAL repeats assembled in the first and second array vectors and a third vector containing the C-terminal truncated TAL repeat are then digested and ligated into a TALENs expression vector that contains the NLS, N-terminal domain, C-terminal domain, catalytic domain, a promoter, a stop codon, and a polyadenylation signal. The resulting expression vector can be transformed into a host cell or in vitro transcribed using techniques that are well known and described in the technical and scientific literature.

In some embodiments, a target nucleic acid sequence in the genome of a host cell is cleaved by introducing the TALEN, or polynucleotide encoding the TALEN into the host cell. In some cases, the polynucleotide is introduced into the host cell by introducing an expression cassette containing a DNA polynucleotide encoding the TALEN into the host cell. In other cases, the polynucleotide encoding the TALEN is mRNA, and the mRNA is introduced into the host cell.

In some cases, two different TALENs are introduced into the host cell, each TALEN encoding a monomer member of an obligate dimer pair (e.g., a member of an obligate heterodimer). For example, one TALEN may be designed to bind a region 5' of the target cleavage site and the other TALEN can be designed to bind a region 3' of the target cleavage site. Introduction of the two TALENs will result in binding of the TALENs to adjacent regions flanking the cleavage site, dimerization of the TALEN catalytic domains, and cleavage of the target cleavage site. In some cases, each TALEN is designed to bind to a different strand of the target nucleic acid.

In some cases, four different TALENs are introduced into the host cell as two pairs of obligate heterodimeric TALENs. Thus, one pair can be designed to cleave a site 5' of a region of interest, and another pair can be designed to cleave a site 3' of a region of interest, to create double stranded breaks in the target nucleic acid that flank the region of interest. In some cases, the flanking double stranded breaks will be repaired in a manner that inactivates or removes the region of interest, such as by non-homologous end joining which can delete the region of interest between flanking double stranded breaks and/or introduce one or more indel mutations therein. In other cases, the flanking double stranded breaks will be repaired in a manner that replaces the region of interest with corresponding endogenous homologous alleles, thus reducing heterozygosity.

In still other cases, the region of interest can be replaced by introducing another heterologous polynucleotide sequence into the host cell that has homology for the region of interest, or has homology for regions adjacent to the double stranded breaks. The flanking region can then be replaced by the heterologous polynucleotide by the homologous repair machinery of the host cell. In some cases, the heterologous polynucleotide can contain one or more selectable or detectable markers such that host cells that have incorporated the heterologous polynucleotide can be identified. In some cases, one or more of the selectable or detectable markers are configured to differentiate between incorporation into the intended site, and incorporation outside of the intended site. For example, the heterologous polynucleotide can contain PCR primer binding site that can detect incorporation near a PCR primer binding site adjacent to the flanking region. Selectable or detectable markers can further be adapted to select or detect for a specific orientation of the heterologous polynucleotide.

In some embodiments, combining the TALEN assembly protocols of the present invention with the expression cassettes of the present invention provides surprising results. For example, in some embodiments, TALENs can be designed, assembled, and introduced into a cell in five days or less. As another example, the TALENs and methods provided herein can provide indel mutations at a significantly greater rate. Specifically, up to 100% of embryos treated with TALENs of the present invention can exhibit indel mutations at the target site. Such high levels of mutation enables the facile use of TALENs to create recombinant organisms with heritable mutations.

EXAMPLES

The following examples are offered to illustrate, but not to limit the claimed invention.

Example 1

Efficient Disruption of miRNA- and Protein-Coding Genes in Zebrafish Using TALENS Introduction Engineered nucleases are fusion constructs of the DNA binding domain of a transcriptional factor with the catalytic domain of FokI nuclease (de Souza, et al., 2012). The DNA binding domain brings the nuclease to a predetermined genomic locus to create DNA double-strand breaks (DSB). Repair of the DSB through the error-prone non-homologous end-joining (NHEJ) pathway leads to targeted gene disruption (Urnov, F. D., et al., 2010). Engineered zinc finger nucleases (ZFNs), created by fusion of zinc finger protein with fokI nuclease (Kim, Y. G., et al., 1996) have been developed as useful tools to knockout genes across species (Bibikova, M., et al., 2002); (Meng, X., et al., 2008); (Doyon, Y., et al., 2008); (Geurts, A. M., et al., 2009); (Young, J. J., et al., 2011). However, because of the context-dependent nature of zinc finger proteins, generating effective ZFNs is labor intensive and time consuming (Isalan, M., 2012). In addition, zinc finger proteins tend to bind to GNN (N representing any nucleotide) and some TNN triple bases, thus limiting the targetable sites of ZFNs in a genome (Isalan, M., 2012). The transcription activator-like effectors (TALEs) of plant pathogens seems able to overcome these limitations of zinc finger proteins (Mussolino, C., et al., 2012); (Bogdanove, A. J., et al., 2011). TALEs bind to DNA through the repeat domain, with one TALE repeat recognizing one DNA base determined by the $12^{th}$ and $13^{th}$ repeat-variable di-residues (RVD) (Moscou, M. J., et al., 2009); (Boch, J., et al., 2009); (Mak, A. N., et al., 2012); (Deng, D., et al., 2012). The simple 1:1 RVD-DNA associations allow modular assembly of customized TALENs for the desired genomic loci (Bogdanov, A. J., et al., 2011). So far, TALENs have been successfully used to modify genes in worms (Wood, A. J., et al., 2011); (Christian, M., et al., 2010), plants (Mahfouz, M. M., et al., 2011); (Cermak, T., et al., 2011), zebrafish (Huang, P., et al., 2011); (Sander, J. D., et al., 2011), rat (Tesson, L., et al., 2011), as well as in cell lines (Miller, J. C., et al., 2011) and human stem cells (Hockemeyer, D., et al., 2011) with efficiencies comparable to the ZFNs. However, the full potentials of this novel TALENs approach are yet to be exploited. Here the inventors describe a fast and robust platform for constructing highly effective TALENs to disrupt both the protein-coding and non-coding genes in zebrafish.

Materials and Methods

Construction of Customized TALENs.

Modified TALEN expression plasmids were assembled as shown in FIG. 1, corresponding to Supp. FIG. 1. These modifications allow assembly of highly effective customized TALENs recognizing 12-31 bp half-sites in five days. The entire procedure includes two digestion-ligation steps as exemplified in FIG. 2, corresponding to Supp. FIG. 2. The protocol to assemble TALENs has been modified from a previous study (Cermak, T., et al., 2011). The modular plasmids (60 ng each) were digested and ligated in a 10 μl volume containing 1 μl BsaI buffer (NEB buffer 4), 0.6 μl BsaI (6 U, NEB), 0.6 μl T4 ligase (600 U, NEB) and 0.4 μl of 25 mM ATP. The reaction was thermocycled according to the following protocol: 6 cycles of 20 min at 37° C. and 10 min at 16° C., then heated to 50° C. for 5 min and then 80° C. for 5 min. Thereafter, 1 μl Plasmid Safe DNase (10 U, Epicentre) was added and digested for 30 min. Five μl of final products were used to transform competent cells. Five white clones were analyzed. The assembled array plasmids were isolated from the correct clone. The second digestion and ligation step was performed in 10 μl volumes containing 60 ng of each array plasmid, pCS2-TALENs-KKR or pCS2-DLE, the last repeat plasmid, 1 μl of Esp3I buffer (NEB buffer 3), 0.6 μl of Esp3I (6 U, NEB), 0.4 μl of T4 ligase (600 U, NEB), 0.4 μl of 25 mM ATP. The reaction was thermocycled according to the following protocol: 6 cycles of 20 min at 37° C. and 10 min at 16° C., then heated to 50° C. for 5 min and then by 80° C. for 5 min. Five μl of the final products were used to transform competent cells. Plasmids were isolated from the correct clones for DNA sequencing. The primers used are listed in Table 1.

TABLE 1

Primers used in Example 1

| Primer name | Primer sequence (5'-3') (SEQ ID NO:) | Primer function |
| --- | --- | --- |
| pCR8_F1 | TTGATGCCTGGCAGTTCCCT (653) | Amplification and sequencing of the assembled |
| pCR8_R1 | CGAACCGAACAGGCTTATGT (654) | TAL repeats in the array plasmids. |
| NTalF | GATGACAAGGGTACCGTG (655) | Amplification and sequencing of the assembled |
| CTalR | CTAGTTGGGATCCGGCAAC (656) | TALENs. |
| Gria3aF | GTCTGTTCATGCGCTCCACGTC (657) | Gria3a genomic DNA fragment amplification; |
| Gria3aR | CTTTTCAATACCGCAATGAGTC (658) | PCR-based mutation detection. |
| Gria3aR1 | ACAGGCGTGCGTGACTG (659) | |
| TnikbF | CATCTAATGACTGCAGAATCAG (660) | Tnikb genomic DNA fragment amplification. |
| TnikbR | GAACTAAACTAGCTACATCCAG (661) | |
| Kiss1rF | GATATGCACACCTCACATCACAC (662) | Kiss1r genomic DNA fragment aplification. |
| Kiss1rR | GTGATCTGGGTTCCCTGTACCAC (663) | |
| Kiss2rF | GATGCTGCAGAGCACATCATGTG (664) | Kiss2r genomic DNA fragment amplification. |
| Kiss2rR | CTGACTTCTACTGTATATACAG (665) | |
| Kiss1F | GAACTCTTCTCTTTCTGAAACAC (666) | Kiss1 genomic DNA fragment aplification. |
| Kiss1R | CCAGTGACAGCTCACGTACAGC (667) | |
| Kiss2F | GTTCACTGAAGAGAGCTCAGTTG (668) | Kiss2 genomic DNA fragment amplification. |
| Kiss2R | CTGGCATAGGCTCTGGTGTGTC (669) | |
| SpexinF | AGGACTCTTGCGGCGTACGCAC (670) | Spexin genomic DNA fragment aplification. |
| SpexinR | GCATAATAGGCTATACCATAAC (671) | |
| GnRH3F | CACATATTATAGCGAAACTGCAC (672) | GnRH3 genomic DNA fragment amplification. |
| GnRH3R | TCTCACCCTGAATGTTGCCTC (673) | |
| MiR-214F | CTAGTAACATTATCTTTATCCTC (674) | MiR-214 genomic DNA fragment aplification. |
| MiR-214R | CACCGCAGAGAGCCTATCCTG (675) | |
| MiR-451F | CTCTCTAGACAGGATATCATCG (676) | MiR-451 genomic DNA fragment amplification. |
| MiR-451R | GTTCTTCGTTCTCTTACATCCAG (677) | |
| MiR-1-1F | GTCTAAATGCTCATATCTGAGG (678) | Mir-1-1 genomic DNA fragment amplification. |
| MiR-1-1R | CATCAGGCCTGCGCATCACAC (679) | |
| MiR-1-2F | CTAATCCACTGCATTGTGCAG (680) | MiR-1-1 genomic DNA fragment amplification. |
| MiR-1-2R | GTGGACTGCTGGTGAAGTTACTG (681) | |
| MiR-17-92N12F | GTGACATGTGCTTTGCCATGAG (682) | MiR-17-92N1, miR-17-92N2, miR-17-92C1 and mir-17-92C2 genomic loci amplification; Q-PCR |
| MiR-17-92N12R | GTTGGGTGTCTTGCCGAAGGATG (683) | (MiR-17-92N12F + MiR-17-92C12R for detection of cluster deletion; Mir-17-792F + |
| MiR-17-92C12F | GTAAAGGATTGTGGAGATTGTACC (684) | Mir-17-92C12R for amplification of reference fragment). |
| MiR-17-92C12R | GACAAAACTTCAGCAGTGAACACAG (685) | |
| MiR-17-92F | GTACACATGCTTAATGCAGAGG (686) | |

TABLE 1-continued

Primers used in Example 1

| Primer name | Primer sequence (5'-3') (SEQ ID NO:) | Primer function |
|---|---|---|
| MiR-430N12F | GTCAGGTAGGTCTTACGCACAC (687) | MiR-430N1 and miR-430N2 genomic loci |
| MiR-430N12R | CACATATTGATCATTACTGCTAAC (688) | amplification. |
| MiR-430C1F | CTGACAGCAACGGGAACAGATG (689) | MiR-430C1 genomic locus amplification. |
| MiR-430C1R | AACGATGCAGAGACAAGACCCTG (690) | MiR-430N12F + MiR-430C1R or MiR-430C2R |
| MiR-430C2F | GTCCCGATAGACTCTGCTAGAG (691) | for detection of miR-430 cluster deletion. |
| MiR-430C2R | CTCGCAGATTGGAATCTATCCTTC (692) | MiR-430C2 genomic locus amplification. |

TALENs mRNA Preparation, Microinjection and Mutation Detection.

To prepare capped mRNA by in vitro transcription, the TALENs expression vectors were linearized by NotI and transcribed using Sp6 mMESSAGE mMACHINE Kit (Ambion). TALENs mRNAs (100-500 pg) were microinjected into one-cell stage zebrafish embryos. The number of normal and deformed embryos were recorded at 24 hour post fertilization (day 1) and 48 hour post fertilization (day 2) (Table 2). After 2 days, genomic DNA was isolated from single or pooled normal larval zebrafish (Foley, J. E., et al., 2009). The target genomic regions were amplified by limited cycles of PCR and subcloned for sequencing (Foley, J. E., et al., 2009). The primers used are listed in Table 1. The mutation frequency is calculated as the number of mutated sequences divided by the number of total sequences.

TABLE 2

TALENs injection records

| Gene targets | mRNA concentration | Total embryo injected | Day 1 | Day 2 |
|---|---|---|---|---|
| Gria3a | 500 pg | 24 | 19(0) | 19(0) |
| Tnikb | 500 pg | 60 | 55(0) | 53(5) |
| Kiss1r | 250 pg | 31 | 30(0) | 30(1) |
| Kiss2r | 500 pg | 32 | 30(0) | 30(0) |
| Kiss1 | 500 pg | 44 | 36(6) | 30(3) |
| Kiss2 | 500 pg | 49 | 35(15) | 28(8) |
| Spexin | 250 pg | 16 | 16(0) | 16(0) |
| GnRH3 | 500 pg | 26 | 26(0) | 25(0) |
| MiR-214 | 500 pg | 39 | 34(14) | 31(10) |
| MiR-451 | 500 pg | 18 | 17(0) | 17(3) |
| MiR-1-1 | 200 pg | 33 | 29(0) | 28(0) |
| MiR-1-2 | 200 pg | 41 | 37(5) | 32(2) |
| MiR-17-92N1C1 | 100 pg | 87 | 78(7) | 68(4) |
| MiR-17-92N2C1 | 100 pg | 54 | 44(3) | 40(3) |
| MiR-17-92N1C2 | 100 pg | 45 | 41(2) | 38(1) |
| MiR-17-92N2C2 | 100 pg | 48 | 41(2) | 39(1) |
| MiR-430N1C1 | 100 pg | 34 | 28(6) | 21(0) |
| MiR-430N2C1 | 100 pg | 34 | 28(6) | 21(3) |
| MiR-430N2C1 | 100 pg | 41 | 37(5) | 23(2) |
| MiR-430N2C2 | 100 pg | 52 | 50(1) | 48(3) |
| Gria3a | 400 pg | 39 | 34(6) | 32(5) |
| Gria3a1A | 400 pg | 42 | 36(5) | 29(1) |
| Gria3a1T | 400 pg | 45 | 39(8) | 28(1) |
| Gria3a1G | 400 pg | 71 | 65(13) | 57(5) |
| Gria3a2A | 400 pg | 49 | 39(2) | 35(3) |
| Gria3a2T | 400 pg | 44 | 36(3) | 31(3) |
| Gria3a2C | 400 pg | 54 | 49(3) | 45(5) |
| Gria3a7C | 400 pg | 44 | 40(4) | 32(3) |
| Gria3a7G | 400 pg | 61 | 52(2) | 49(2) |
| Gria3a7T | 400 pg | 42 | 35(4) | 31(2) |
| Gria3a8A | 400 pg | 46 | 44(4) | 38(4) |
| Gria3a8C | 400 pg | 52 | 46(3) | 39(5) |
| Gria3a8G | 400 pg | 49 | 49(1) | 43(3) |
| Gria3a15A | 400 pg | 47 | 46(2) | 40(0) |
| Gria3a15G | 400 pg | 66 | 65(5) | 59(3) |
| Gria3a15C | 400 pg | 39 | 35(1) | 33(3) |

TABLE 2-continued

TALENs injection records

| Gene targets | mRNA concentration | Total embryo injected | Day 1 | Day 2 |
|---|---|---|---|---|
| Gria3aLRA | 400 pg | 35 | 33(5) | 22(3) |
| Gria3aLRT | 400 pg | 33 | 25(4) | 19(4) |
| Gria3aLRG | 400 pg | 54 | 45 | 44(5) |
| Gria3a-1C | 400 pg | 39 | 32(7) | 32(7) |
| Gria3a-2G | 400 pg | 46 | 43(3) | 40(8) |
| Gria3a-7A | 400 pg | 54 | 51(0) | 51(0) |
| Gria3a-8T | 400 pg | 36 | 36(1) | 35(1) |
| Gria3a-15T | 400 pg | 50 | 43(3) | 37(4) |
| Gria3a-LRC | 400 pg | 35 | 35(0) | 35(1) |

The total number of embryonic survivals are shown, with the number of deformed embryos in brackets.

Q-PCR Analysis of miRNA-17-92 Cluster Deletion.

Quantitative real-time PCR was performed on an ABI PRISM 7900 Sequence Detection System (Applied Biosystems) using the SYBR Green I Kit (ABI, Japan) according to the manufacturer's protocol. Standard curves were generated by serial dilution of the plasmid DNA for each target fragment. The copy number was determined by relating the measured threshold cycle values of each sample to the standard curve. The DNA fragment deletion frequency was calculated as the copy number of genomic DNA with the miRNA-17-92 cluster deleted divided by the copy number of total genomic DNA. Data are provided in Table 3.

TABLE 3

Q-PCR analysis of miR-17-92 cluster deletion frequencies

| Injected TALENs | Sample number | Copy number of genomic DNA (miR-17-92 deleted) | Copy number of genomic DNA (total) | Deletion frequency (%) |
|---|---|---|---|---|
| N1C1 | 1 | 114,257 | 1,703,296 | 6.71 |
|  | 2 | 91,319 | 1,071,933 | 8.52 |
|  | 3 | 72,406 | 1,676,756 | 4.32 |
|  | 4 | 97,968 | 2,457,103 | 3.99 |
|  | 5 | 72,413 | 1,519,203 | 4.77 |
|  | 6 | 2513 | 1,569,172 | 0.16[a] |
|  | 7 | 94,507 | 1,423,069 | 6.64 |
|  | 8 | 82,328 | 1,474,990 | 5.58 |
| N2C1 | 1 | 54,041 | 1,508,453 | 3.58 |
|  | 2 | 52,523 | 1,575,282 | 3.33 |
|  | 3 | 172,426 | 1,119,823 | 15.40 |
|  | 4 | 43,007 | 1,363,943 | 3.15 |
|  | 5 | 75,809 | 1,471,703 | 5.15 |
|  | 6 | 75,599 | 1,686,177 | 4.48 |
|  | 7 | 93,037 | 1,526,746 | 6.09 |
|  | 8 | 82,116 | 1,708,420 | 4.81 |
| N1C2 | 1 | 10,603 | 1,259,254 | 0.84 |
|  | 2 | 32,084 | 1,374,637 | 2.33 |
|  | 3 | 10,361 | 1,023,137 | 1.01 |
|  | 4 | 3,601 | 1,389,421 | 0.26 |
|  | 5 | 15,981 | 1,334,318 | 1.20 |

TABLE 3-continued

Q-PCR analysis of miR-17-92 cluster deletion frequencies

| Injected TALENs | Sample number | Copy number of genomic DNA (miR-17-92 deleted) | Copy number of genomic DNA (total) | Deletion frequency (%) |
|---|---|---|---|---|
| | 6 | 26,657 | 1,854,493 | 1.44 |
| | 7 | 14,868 | 1,252,684 | 1.19 |
| | 8 | 16,827 | 1,797,042 | 0.97 |
| N2C2 | 1 | 22,021 | 1,797,042 | 1.23 |
| | 2 | 15,726 | 516,973 | 3.04 |

TABLE 4

Disruption of zebrafish protein-coding and miRNA genes by TALENs

| Gene name | TALENs target site (SEQ ID NO:) | L/S/R | Mutant alleles/ total alleles |
|---|---|---|---|
| Gria3 | TCGTCCAATAGCTTCTCagtcacgcacgcctgtGAGTTTCTGCTCTTTA (693) | 17/16/16 | 49/55 |
| Tnikb | TGTTATTTTCTCCCCTaaggatcctgcgggcATTTTTGAGCTGGTGGA (694) | 16/15/17 | 18/39 |
| Kiss1r | TTCATGTGCAAATTTGTtgcttttcttcaacagGTAATAATAGAACCTCA (695) | 17/16/17 | 22/43 |
| Kiss2r | TAACCTAATAGTCATCTAtgtggtcattaaaaaccagcaGATGAAGACGGTTACAAA (696) | 18/21/18 | 3/45 |
| Kiss1 | TACACACAAACCCCTCTgggcattttcagtattaCTTAGAAGGTAAGTTCA (697) | 17/17/17 | 32/40 |
| Kiss2 | TGATTCTCTTCATGTCTGcaatggtcagtcagtctaCAGCTATGAGAGCAATA (698) | 18/18/17 | 69/69 |
| GnRH3 | TGTTTTAGTTTTAGCATGgagtggaaaggaaggttgctgGTCCAGTTGTTGCTGTTA (699) | 18/21/18 | 6/33 |
| Spexin | TTTGTGTCCCATTCCTggagcgcacccaaggtAATGTCATGCAATGTTA (700) | 16/16/17 | 33/36 |
| MiR-214 | TGCAGAACTTCCTGCACctgtacagcaggcacagaCAGGCAGACAGATGGCA (701) | 17/18/17 | 25/47 |
| MiR-451 | TCGCTGTGACAGAGAGAggcggcgaaaccgttaccattaCTGAGTTTAGTAATGGA (702) | 17/22/18 | 2/47 |
| MiR-1-1 | TATGAACAAGAGCAGCtatggaatgtaaagaaGTATGTATCCCAGGTGA (703) | 16/16/17 | 64/66 |
| MiR-1-2 | TATGAACATATAAAAGCtatggaatgtaaagaaGTATGTATTCTTGGTCA (704) | 17/16/17 | 34/41 |

TALENs binding sites are shown in uppercase letters. Spacers are shown in lowercase letters.
L: left binding site; S: spacer; R: right binding site.

TABLE 3-continued

Q-PCR analysis of miR-17-92 cluster deletion frequencies

| Injected TALENs | Sample number | Copy number of genomic DNA (miR-17-92 deleted) | Copy number of genomic DNA (total) | Deletion frequency (%) |
|---|---|---|---|---|
| | 3 | 7,617 | 1,392,856 | 0.55 |
| | 4 | 25,828 | 1,307,844 | 1.97 |
| | 5 | 33,628 | 745,868 | 4.51 |
| | 6 | 17,112 | 1,071,918 | 1.60 |
| | 7 | 60,032 | 781,948 | 7.68 |
| | 8 | 45,092 | 933,980 | 4.83 |

*Data not used in FIG. 7d.

Results and Discussion

The inventors have developed the TALENs expression vectors to achieve two aims: (1) to make the vectors compatible with the existing TALENs toolkit (Cermak, T., et al., 2011) in golden gate assembly; and (2) to make the assembled TALENs suitable for genomic manipulation in animals. The optimized TALENs expression vectors contain a SP6 promoter, a nuclear localization signal, a truncated TAL effectors architecture (Miller, J. C., et al., 2011), an improved DLE/KKR obligate heterodimeric fokI (Doyon, Y., et al., 2011) and two Esp3I sites allowing golden gate assembly (FIG. 1, corresponds to Supp. FIG. 1). Using our optimized system, customized TALENs recognizing 12-31 bp half-sites can be routinely assembled by two digestion-ligation steps in five days (FIG. 2, corresponds to Supp. FIG. 2).

This platform for construction of novel TALENS was validated by assembling TALENs for two zebrafish genes (gria3a and tnikb) which have been successfully disrupted in recent studies using TALENs (Huang, P., et al., 2011); (Sander, J. D., et al., 2011). The resulting TALENS provided a 2 to 3 fold increased mutation frequency prepared by the instant platform as compared to previously reported TALENS for the same targets (Table 4, FIG. 3, corresponds to Supp. FIG. 3). These data demonstrate the superior nature of the TALENs generated by our method.

Figure 4:
FIG. 4: illustrates the results of disruption of zebrafish genes involved in the neuroendocine control of reproduction. (a) Schematic diagram of target genes disrupted by TALENs. (b-g) Spectrum and frequency of TALENs induced mutations in kiss1r (b) (WT=SEQ ID NO:172; mutations=SEQ ID NOS:173-191), kiss2r (c) (WT=SEQ ID NO:192; mutations=SEQ ID NOS:193-195), kiss1 (d) (WT=SEQ ID NO:196; mutations=SEQ ID NOS: 197-215), kiss2 (e) (WT=SEQ ID NO:216; mutations=SEQ ID NOS:217-239), gnrh3 (f) (WT=SEQ ID NO:240; mutations=SEQ ID NOS: 241-246) and spexin (g) (WT=SEQ ID NO:247; mutations=SEQ ID NOS:248-268) loci. The TALENs binding sites are shown in shaded background. Deletions are indicated by dash lines and insertions are indicated by lowercase letters. The number of times each mutant allele appearing is shown on the right side of the mutant allele.

TALENs for six other zebrafish genes (kiss1r, kiss2r, kiss1, kiss2, gnrh3 and spexin) involved in the neuroendocrine control of reproduction have also been assembled. The assembled TALENs could efficiently introduce targeted mutations to these genes in zebrafish embryonic cells with frequencies ranging from 6.6% to 100% (Table 4). All these mutations have occurred at the spacer region by adding or deleting some nucleotides, in a manner consistent with repair of DSB around the spacer region by the NHEJ pathway. Most of these mutations cause shifts of the open reading frames and disruption of the functional protein domains (FIG. 4, corresponds to Supp. FIG. 4). Although ZFNs context-dependent assembly (CoDA) sites (Sander, J. D., et al., 2011) are also present in both the kiss1r and kiss2r genes, testing one CoDA site for each of these genes failed to produce mutation (data not shown). Neither CoDA nor oligomerized pool engineering sites (Maeder, M. L., et al., 2009) could be identified for the other four genes. The above results indicated that TALENs could be more efficiently and widely used to disrupt zebrafish genes than ZFNs.

MicroRNAs are small RNA molecules of 21-23 nucleotides silencing their target mRNA by posttranscriptional mechanisms (Bartel, D. P., 2009). Loss-of-function of genes involved in the miRNA biogenesis pathway or knockout of individual miRNA revealed that miRNAs participate in a wide range of biological processes (Bartel, D. P., 2009). However, targeted knockout of miRNA has not been achieved in other species apart from mouse. To investigate whether TALENs could be employed to disrupt zebrafish miRNAs, the inventors have assembled TALENs for four zebrafish miRNAs, namely miR-214, miR-451, miR-1-1 and miR-1-2. The miRNA seed (a region critical for miRNA-mRNA pairing) has been placed at the spacer because deletions and insertions often occur in this region. All the TALENs introduce intended mutations with frequencies ranging from 4.3% to 97% (Table 4). Nearly all these mutations alter the miRNA seed, thus leading to loss-of-function of the miRNAs (FIG. 5a, corresponding to original FIG. 1a and FIG. 6, corresponding to supplementary FIG. 5). Moreover, the insertion or deletion of nucleotides also alters the hairpin structure of pre-miRNA (FIGS. 5b and 6), thus leading to abnormal miRNA biogenesis.

Figure 6:
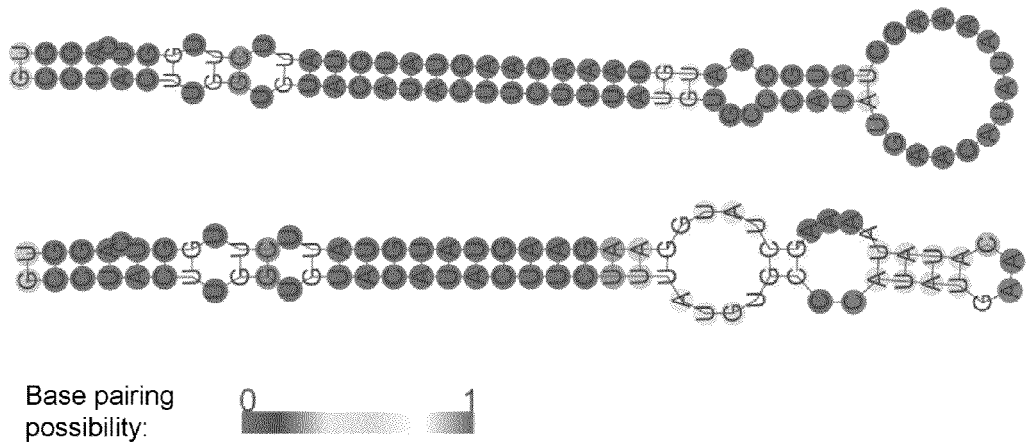
FIG. 6: depicts results of disruption of zebrafish miR-451, miR-1-1, and miR-1-2 loci by TALENs. (a) Frequency and spectrum of TALENs induced miR-451 mutations (WT=SEQ ID NO:284; mutations=SEQ ID NOS:285 and 286). (b) Disruption of the hairpin structure of pre-miRNA mutant. Upper panel, the hairpin structure of the wild type pre-miR-451 (SEQ ID NO:287); lower panel, the hairpin structure of the pre-miR-451 mutant in (a) with 20 by sequence deleted (SEQ ID NO:288). (c) Frequency and spectrum of TALENs induced miR-1-1 mutations (WT=SEQ ID NO:289; mutations=SEQ ID NOS:290-318). (d) Disruption of the hairpin structure of pre-miRNA mutant. Upper panel, the hairpin structure of wild type pre-miR-1-1 (SEQ ID NO:319); lower panel, the hairpin structure of the most frequently sequenced pre-miR-1-1 mutant in (c) (SEQ ID NO:320). (e) Frequency and spectrum of TALENs induced miR-1-1 mutations (WT=SEQ ID NO:321; mutations=SEQ ID NOS:322-341). (f) Disruption of the hairpin structure of pre-miRNA mutant. Upper panel: the hairpin structure of the wild type pre-miR-1-2 (SEQ ID NO:342); lower panel: the hairpin structure of the most frequently sequenced pre-miR-1-2 mutant in (e) (SEQ ID NO:343). The TALENs binding sites are shown in shaded background. DNA sequences encoding mature miRNA are underlined, with the miRNA seed sequence in bold. Deletions are indicated by dash lines and insertions are indicated by lowercase letters. The number of times each mutant allele appearing is shown on the right side of the mutant allele.
Figure 7:
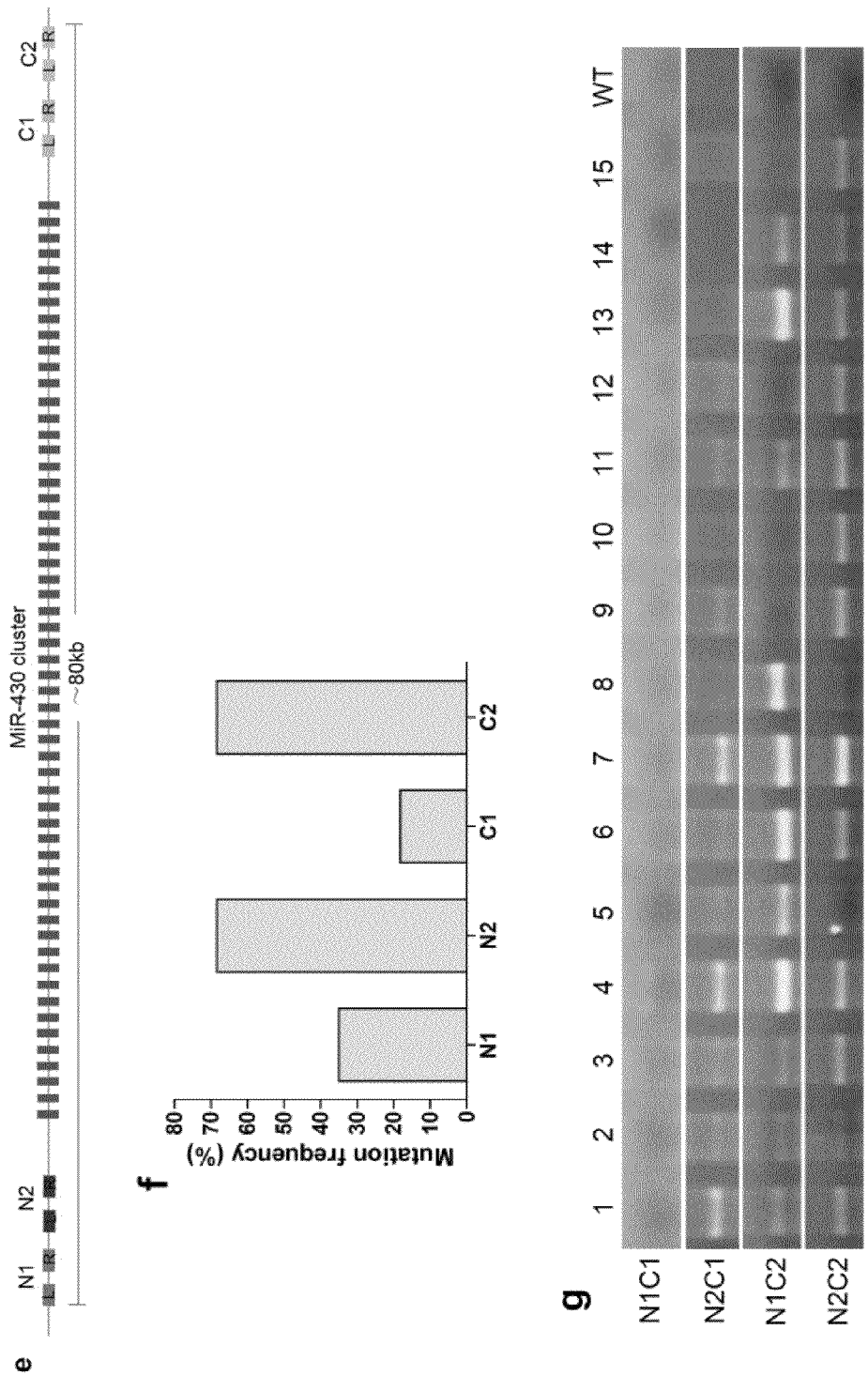
FIG. 7: illustrates targeted deletion of miRNA clusters by TALENs. (a) Schematic representation of DNA fragment deletion. Four TALENs were designed for a target DNA fragment. The combination of two TALENs (NxCy: N1C1, N1C2, N2C1 or N2C2) will create two concurrent DSB sites. Repair of the two DSB by joining the broken N-C ends will allow deletion of the flanking DNA fragment. (b) Schematic representation of zebrafish miR-17-92 cluster and TALENs designed for miR-17-92 cluster deletion. Dark rectangle, individual miRNA genes in the cluster. (c) Mutation frequency of TALENs at each target site around the miR-17-92 cluster. Eight embryos were pooled for mutation frequency analysis after the cocktail NxCy TALENs injections. (d) Deletion frequency of the miR-17-92 cluster. Genomic DNA was isolated from individual zebrafish embryos and quantified by Q-PCR. Data shown are mean values±S.E.M (N=7-8). (e) Schematic representation of zebrafish miR-430 cluster and TALENs designed for miR-430 cluster deletion. (f) Mutation frequency of TALENs at each target site around the miR-430 cluster. Mutation frequency analysis is performed as in (c). (g) Genomic PCR detection of miR-430 cluster deletion. Gel pictures show 40 cycles PCR amplification of genomic DNA isolated from individual zebrafish embryos microinjected with NxCy TALENs or wild type (WT) controls.
Figure 9:
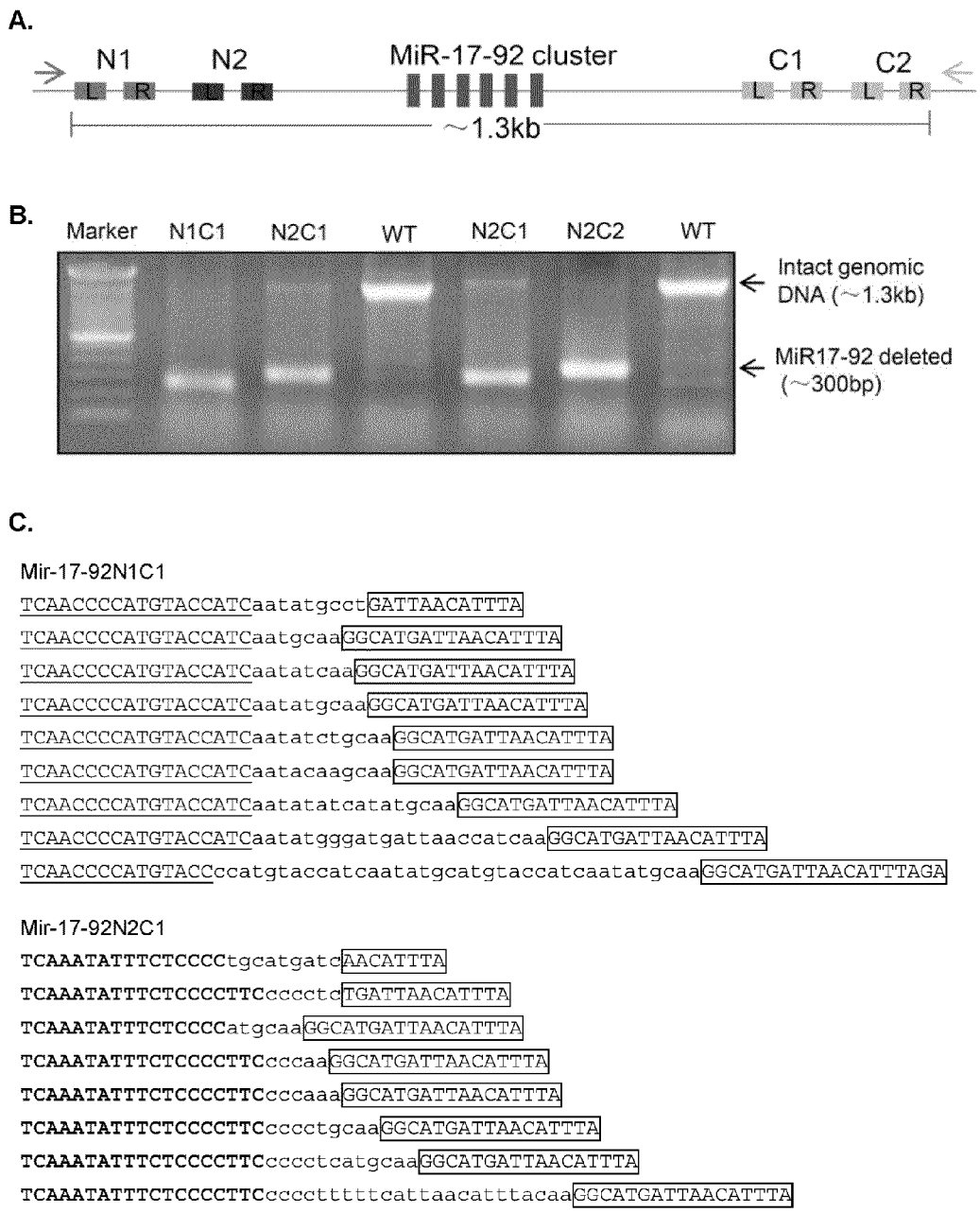
FIG. 9: depicts method and results for confirmation of miR-17-92 cluster deletion by genomic PCR and DNA sequencing. (a) Primers position on the zebrafish miR-17-92 cluster. Primers are indicated by arrows. (b) Genomic PCR. Gel picture shows 40 cycles PCR amplification of genomic DNA isolated from the pooled zebrafish embryos microinjected with the cocktail TALENs or WT controls. WT, wild type. (c) Sequencing results confirm miR-17-92 cluster deletion. Mir-17-92N1C1 mutations=SEQ ID NOS:367-375. Mir-17-92N2C1 mutations=SEQ ID NOS:376-383. Mir-17-92N1C2 mutations=SEQ ID NOS:384-393. Mir-17-92N2C2 mutations=SEQ ID NOS:394-403. Lowercase letters are nucleotide sequences between the binding sites.

About half of miRNAs in the zebrafish genome are arranged in tandem and are transcribed as polycistronic units (Thatcher, E. J., et al., 2008). Here the inventors have further investigated whether TALENs could be used to knockout miRNA gene clusters. The strategy to knockout a miRNA cluster is to create DSB simultaneously at both ends of the cluster. Repair of the DSB by religation of the N-terminal and C-terminal broken ends will lead to deletion of the internal DNA fragment (FIG. 7a, corresponding to original FIG. 2a). To test this combinatorial approach, the inventors have designed four TALENs for the zebrafish miRNA-17-92 cluster to delete a 1.3 kb genomic fragment encoding six miRNA genes (FIG. 7b). To create two concurrent DSBs, four combinations of each of the two N-terminal and C-terminal TALENs were used, and each TALENs induced mutations of its target locus with high frequency (FIGS. 7c and 8, corresponding to Supp. FIG. 6). Primers were designed to detect deletion of the miRNA-17-92 cluster. PCR amplification of genomic DNA isolated from the pooled embryos indicated successful deletion of the miRNA-17-92 cluster by the cocktail nucleases (FIG. 9, corresponding to Supp. FIG. 7). Sequencing of the PCR products confirmed deletion of the miRNA-17-92 cluster (FIG. 9). A small number of nucleotide deletion or insertion is found at the ligation sites, indicating religation of the broken ends by the NHEJ mechanism. Q-PCR was performed to evaluate the deletion frequencies of the miRNA-17-92 cluster from individual zebrafish embryos. The mean deletion frequencies were found to range from 1.4% to 5.8% (FIG. 7d and Table 3). Encouraged by the above results, the inventors have subsequently assembled four TALENs for the zebrafish miR-430 cluster to knockout an 80 kb genomic fragment containing 57 miR-430 genes (FIG. 7e). Each TALENs introduced mutations to the intended locus with high frequency after microinjection of the cocktail TALENs (FIGS. 7f and 10, corresponding to Supp. FIG. 8). Successful deletion of this gene cluster by all combinations of the cocktail nucleases is confirmed by genomic PCR and DNA sequencing (FIG. 11, corresponding to Supp. FIG. 9). As shown in FIG. 7g, deletion of the miR-430 cluster in individual zebrafish embryos is also confirmed. Collectively, these results indicated that TALENs could efficiently disrupt both protein-coding and non-coding genes in zebrafish, making targeted small alterations or large DNA fragment knockout possible.

The potential off-target effects of TALENs have largely been unaddressed. Codon degeneracy has been observed between RVD-DNA interactions (Moscou, M. J., et al., 2009); (Boch, J., et al., 2009), which may lead to the off-target effects of the engineered TALENs. To test this, the inventors have generated an array of one-base-mismatch TALENs mutants for the gria3a locus (FIG. 12, corresponding to original FIG. 3, and Table 5).

TABLE 5

Off-target cleavage of gria3a locus by TALENs mutants

| TALENs mutants | Mutant alleles/ total alleles | Mutation frequency (%) | TALENs mutants | Mutant alleles/ total alleles | Mutation frequency (%) |
|---|---|---|---|---|---|
| WT | 27/32 | 84.4 | A7T | 24/32 | 75.0 |
| WT | 26/32 | 81.2 | A7T | 22/32 | 68.8 |
| WT | 27/31 | 87.1 | A7T | 23/32 | 71.9 |
| -C1 | 24/63 | 38.1 | A7C | 12/32 | 37.5 |
| -C1 | 21/63 | 33.3 | A7C | 11/32 | 34.4 |
| -C1 | 13/63 | 20.6 | A7C | 15/31 | 48.4 |
| -G2 | 0/64 | 0 | A7G | 20/32 | 62.5 |
| -G2 | 2/64 | 3.1 | A7G | 30/32 | 93.8 |
| -G2 | 1/64 | 1.6 | A7G | 29/32 | 90.6 |
| -A7 | 0/64 | 0 | T8A | 0/32 | 0 |
| -A7 | 1/64 | 1.6 | T8A | 0/32 | 0 |
| -A7 | 0/64 | 0 | T8A | 0/32 | 0 |
| -T8 | 0/64 | 0 | T8C | 9/32 | 28.1 |
| -T8 | 0/64 | 0 | T8C | 8/32 | 25.0 |
| -T8 | 0/64 | 0 | T8C | 4/32 | 12.5 |
| -T15 | 47/64 | 73.4 | T8G | 6/32 | 18.8 |
| -T15 | 47/64 | 73.4 | T8G | 3/32 | 9.4 |
| -T15 | 47/64 | 68.8 | T8G | 5/32 | 15.6 |
| C1A | 20/64 | 31.3 | T15A | 8/32 | 25 |
| C1A | 21/64 | 32.8 | T15A | 6/32 | 18.8 |
| C1A | 23/64 | 35.9 | T15A | 6/32 | 18.8 |
| C1T | 0/64 | 0 | T15C | 1/32 | 3.1 |
| C1T | 0/64 | 0 | T15C | 0/32 | 0 |
| C1T | 4/64 | 6.3 | T15C | 2/32 | 6.3 |
| C1G | 48/64 | 75.0 | T15G | 28/32 | 87.5 |
| C1G | 56/64 | 87.5 | T15G | 21/32 | 65.6 |
| C1G | 48/64 | 75.0 | T15G | 14/32 | 43.8 |
| G2A | 14/63 | 22.2 | CLRA | 29/32 | 90.6 |
| G2A | 10/64 | 15.6 | CLRA | 19/32 | 59.4 |
| G2A | 10/63 | 15.9 | CLRA | 25/32 | 78.1 |
| G2T | 17/32 | 53.1 | CLRT | 18/32 | 56.3 |
| G2T | 18/32 | 56.3 | CLRT | 18/31 | 58.1 |
| G2T | 15/31 | 48.4 | CLRT | 24/32 | 75.0 |
| G2C | 6/64 | 9.4 | CLRG | 2/31 | 6.5 |
| G2C | 7/62 | 11.3 | CLRG | 0/32 | 0 |
| G2C | 10/64 | 15.6 | CLRG | 0/32 | 0 |

Data were collected from three independent studies of eight pooled zebrafish embryos.

The results suggested several interesting features when TALENs interact with the imperfect endogenous locus. First, deletions are more harmful than substitutions to destroy the TALENs activities. Deletion mismatches at both terminals of the target site impair TALENs activities whereas those in the middle region nearly abolish the TALENs activities. Second, some RVD-DNA non-matches strongly impair TALENs activities, whereas others are tolerated. Third, RVD-DNA interactions are position-dependent and all positions contribute to TALENs activities. Fourth, each RVD shows different stringency, with RVD coding for C, T and A more stringent than that for G in general. All the TALENs used in the this Example recognize 16-19 bp half-sites and 31-38 bp full sites. Homology-based searching on the zebrafish genome can only identify the poor off-target sites with more than five nucleotide mismatches. Moreover, most of the microinjected TALENs produce minor toxicities in the zebrafish embryos (Table 2). These data indicated that TALENs recognize their targets with great specificity.

Figure 12:
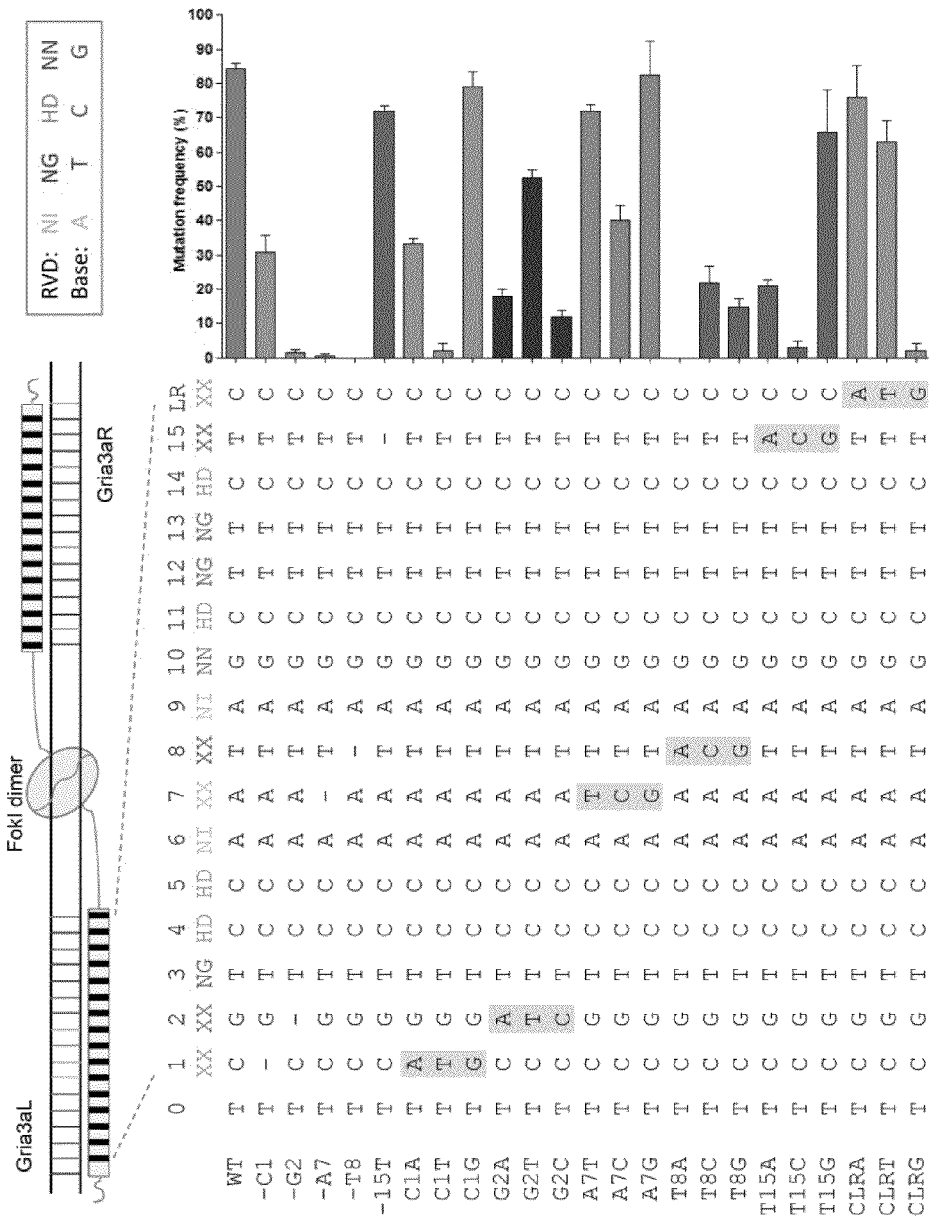
FIG. 12: depicts off-target cleavage of one-nucleotide-mismatched endogenous loci by TALENs. TALENs mismatches to the left binding site of zebrafish gria3a were constructed and tested for their efficiency to disrupt the endogenous gria3a locus. Left panel, TALENs and their target sequences (WT=SEQ ID NO:462; mutations=SEQ ID NOAS:463-485); XX, RVD recognizing the indicated nucleotides (in gray background) or deleted nucleotides. Right upper panel, the RVD-DNA associations; right lower panel, mutation frequency of gria3a locus. WT, wild type; LR, last repeat. The mutation frequencies were estimated by PCR from pooled 6-8 embryos. Data shown are mean values ±S.E.M from three replicates.

In this Example, the inventors have described a robust platform to construct TALENs in a cost-effective, timesaving and reliable manner. The success rate is about 95% as indicated in the targeted disruption of 20 endogenous loci in zebrafish, with the mutation frequency often reaching above 50%. Moreover, both protein coding and non-coding genes could be disrupted, and either small nucleotide alterations or large fragment knockouts could be achieved. Given the simple procedures that the inventors have developed, it is now possible for every molecular laboratory to adopt this platform to construct highly effective tailor-made TALENs in five days. Several parameters need to be considered when designing customized TALENs. First, position 0 ought to be T, as this is always observed in the target sites of the natural TALEs (Moscou, M. J., et al., 2009); (Boch, J., et al., 2009). Second, the half-site length is recommended to be 16-19 bp. Longer half-sites potentially decrease TALENs activities (data not shown). Third, the ideal spacer is around 16-18 bp long. Larger spacers may decrease TALENs activities (Table 4). Fourth, less than four G in a half-site is recommended since the RVD NN is less selective (FIG. 12). Recent studies reported using the RVD NK to recognize G with better specificity (Miller, J. C., et al., 2011), but the mutation efficiency drops about two fold in such substitutions (Huang, P., et al., 2011). High specificity of TALENs is expected since long binding sites of TALENs make their targets unique in the genome. Even when the spacer length is ideal, a single position mismatch between a TALEN recognition site and the target site can impair the nuclease activity (FIG. 12). Given the simple modular assembly of TALENs which can reliably and efficiently induce targeted mutations or deletions with high specificity, this approach is a widely applicable for genome research across species.

Example 2

Efficient Targeted Gene Disruption in *Xenopus* Embryos Using Engineered TALENS

Introduction

Among current animal models, *Xenopus laevis* and *Xenopus tropicalis* are classical animal models widely used in the study of embryonic development. However, because of the lack of methodologies for homologous recombination and embryonic stem cell derivation, it is difficult to perform specific gene targeting in these two models, which has impeded their use in genetic studies. Recently, site-specific gene targeting with transcription activator-like effector nucleases (TALENs) has been successfully applied in several animal models including rat, zebrafish, and *Caenorhabditis elegans* (Huang P, et al., 2011; Tesson L, et al., 2011; Sander J D, et al., 2011; Wood A J, et al., 2011).

Similar to zinc finger nucleases (ZFNs) (Sander J D, et al., 2011), TALENs are engineered DNA nucleases that consist of a custom-designed DNA-binding domain and a nonspecific nuclease domain derived from Fok I endonuclease. Binding of adjacent TALENs allows dimerization of the endonuclease domains, leading to double-strand breaks at the predetermined site (Kim Y G, Cha J, Chandrasegaran S, 1996). These double-strand DNA breaks are frequently repaired through nonhomologous end joining (NHEJ) (Mani M, et al., 2005; Smith J, et al., 2000), resulting in deletion or insertion (indel) mutations.

The DNA binding specificity of TALENs, as distinct from ZFNs, is based on the transcription activator-like effectors (TALEs) from *Xanthomonas* plant pathogens (Bogdanove A J, et al., 2010; Boch J, et al., 2010). The TALE proteins consist of an N-terminal translocation domain, a nuclear localization signal, and various numbers of tandem 34-aa repeats that determine the DNA binding specificity. Each repeat in the tandem array is identical except for two variable amino acid residues at positions 12 and 13 called repeat variable di-residues (RVDs), through which each repeat independently determines the targeted base (Boch J, et al., 2009; Moscou M J, et al., 2009). It is known that the RVDs NI, NG, HD, and NN preferentially recognize adenine (A), thymine (T), cytosine (C), and guanine (G)/adenine (A), respectively (Cermak T, et al., 2011). With a given repeat combination, the TALE recognizes a specific target sequence predicted by this code.

A pair of TALENs can then cleave double-strand DNA between the two targeting sites upon dimerization of the Fok I nuclease domain. Here, the inventors evaluated whether this technology can be applied for gene targeting in *Xenopus* embryos. Because ZFNs have been successfully used to disrupt the noggin in *X. tropicalis* embryos (Young J J, et al., 2011), ZFNs were used as positive controls to evaluate the efficiency of TALENs in this system. It was found that TALENs were highly efficient in targeted genes disruption, resulting in mostly short indel mutations in *Xenopus* embryos. Importantly, such TALEN-induced mutations were passed efficiently to the next generation through the germ line. Our study indicates that TALENs are robust tools for targeted gene disruption in *Xenopus* embryos.

Materials and Methods

Construction of TALENS.

TALEs targeting endogenous genes are constructed through Golden Gate TALEN Assembly (Cermak T, et al., 2011). ELD/KKR (Miller J C, et al., 2007) derived from Fok I nuclease domains were used for constructing TALENs. The plasmids for TALEN assembly were obtained from Addgene. The DNA fragment encoding N-terminal to C-terminal in pTAL1 vector was transferred into pCS2+KKR and pCS2+ELD, and these two vectors became feasible to TALEN assembly (FIG. 13, corresponding to original FIG. S1). The plasmids containing ptf1a/p48-ZFN coding sequences were purchased from Sigma, and the DNA encoding noggin-ZFNs were synthe-sized according to Yong et al. (Young J J, et al., 2011) and then subcloned into pCS2+KK and pCS2+EL.

Manipulation of *Xenopus* Embryos.

*X. tropicalis* and *X. laevis* were treated with human chorionic gonadotropin as described (Zhao H, et al., 2012; Zhao H, et al., 2008). The TALEN and ZFN plasmids were linearized by NotI, and mRNAs were synthesized by the mMessage mMachine kit (Ambion). TALENs and ZFNs mRNAs were microinjected into *Xenopus* embryos at the one-cell stage.

Detection of Somatic Mutations in TALEN-Targeted *Xenopus* Embryos.

Figure 14:
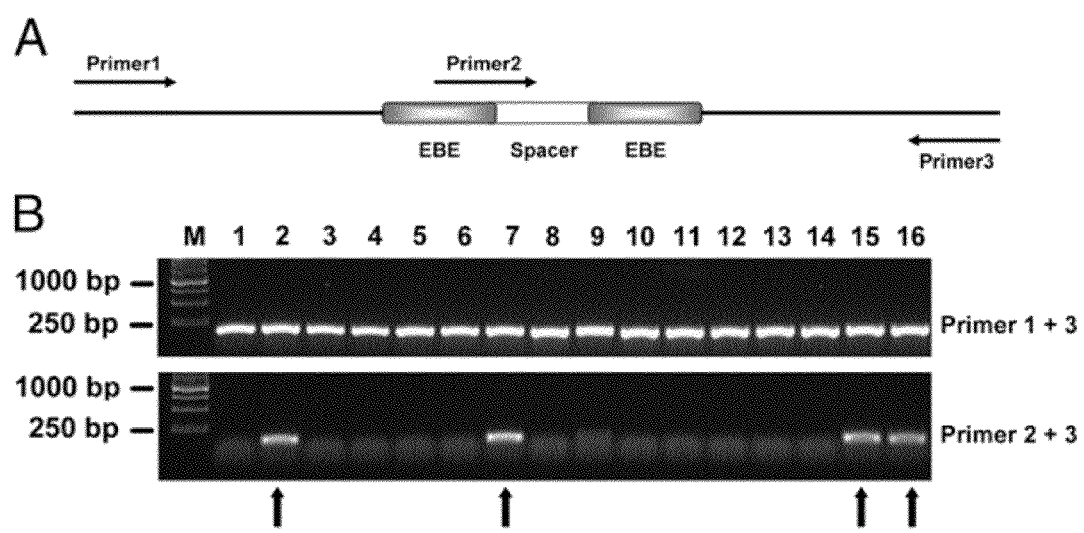
FIG. 14: Mutagenesis detection by PCR. (A) Schematic drawing of primer pairs used for detecting mutagenesis by PCR. (B) A representative DNA gel displaying results of colony PCR with the two primer pairs to detect mutagenesis in *X. tropicalis* embryos injected with ets1-TALENs. In the upper panel, the ~200-bp fragments amplified with primer pair 1, 3, indicates the presence of the targeted sequence in the plasmids. In the lower panel, the absence of PCR products for primer pair 2, 3, indicates the presence of targeted mutations, whereas a ~140-bp fragment is amplified from wild-type sequences (indicated by arrows).

Fortyeight hours after microinjection, TALEN or ZFN-targeted embryos were pooled for genomic DNA extraction (five embryos for each pool). PCR was performed using primers 1 and 3 (FIG. 14, corresponding to original FIG. 2, and Table 6). Amplicons harboring targeted gene fragments were subcloned into pMD-18T by TA cloning (Takara). Colony PCR was performed to examine the occurrence of mutations at the targeted sites and to determine mutagenesis rate, using primer pair 1, 3, and primer pair 2, 3, respectively (FIG. 14 and Table 6). If mutations are generated in the spacer region, no amplicon can be detected using the primer pair 2, 3. PCR-positive plasmids were verified by DNA sequencing.

TABLE 6

Primers used for colony PCR

| | | | | |
|---|---|---|---|---|
| X. tropicalis | noggin | TALEN | P1 | GGTGATCGAGCTGAAAGTGAA (SEQ ID NO: 705) |
| X. tropicalis | noggin | TALEN | P2 | GTGAAAACCTACCACTGGTGG (SEQ ID NO: 706) |
| X. tropicalis | noggin | TALEN | P3 | CTTTTGCATTAGTCCAAGAGTCTC (SEQ ID NO: 707) |
| X. tropicalis | noggin | ZFN | P2 | TATTGAGCATCCGGATCCTAT (SEQ ID NO: 708) |
| X. tropicalis | p48 | TALEN | P1 | GCAGAAGCGCAATGCTATG (SEQ ID NO: 709) |
| X. tropicalis | p48 | TALEN | P2 | GACCATTCCTCTAGGGACGC (SEQ ID NO: 710) |
| X. tropicalis | p48 | TALEN | P3 | GTGTCTACCTTGGACAGTCGC (SEQ ID NO: 711) |
| X. tropicalis | p48 | ZFN | P2 | TGGAGTCCTTCCCTTCCCC (SEQ ID NO: 712) |
| X. tropicalis | ets1 | TALEN | Pre P1 | GGTTCGTGTTTGGATACAAGTACC (SEQ ID NO: 713) |
| X. tropicalis | ets1 | TALEN | Pre P3 | AAAAGTATGTTCAACCCAAGCC (SEQ ID NO: 714) |
| X. tropicalis | ets1 | TALEN | P1 | TCCCCGAGAATGGACAGAC (SEQ ID NO: 715) |
| X. tropicalis | ets1 | TALEN | P2 | CTCTGAAAGGAGTGGACTTTCAG (SEQ ID NO: 716) |
| X. tropicalis | ets1 | TALEN | P3 | CTTTCTGTAAGATCTCCAAGTGCT (SEQ ID NO: 717) |
| X. laevis | ets1a | TALEN | P1 | TCCCCGAGAATGGACAGAC (SEQ ID NO: 718) |
| X. laevis | ets1a | TALEN | P2 | CTCTGAAAGGAGTGGACTTTCAG (SEQ ID NO: 719) |
| X. laevis | ets1a | TALEN | P3 | CTTTCTGCAAGATCTCCAAGTG (SEQ ID NO: 720) |
| X. tropicalis | hex | TALEN | P1 | ACATGAAAACCTGTGTTTTGTAAC (SEQ ID NO: 721) |
| X. tropicalis | hex | TALEN | P2 | CAACTGTGCACATTAACTGCTG (SEQ ID NO: 722) |
| X. tropicalis | hex | TALEN | P3 | TTGTGCAATTAGGCAAAATATTAC (SEQ ID NO: 723) |
| X. tropicalis | vpp1 | TALEN | P1 | AAACTCTGCCCATTATACTGGC (SEQ ID NO: 724) |
| X. tropicalis | vpp1 | TALEN | P2 | CTTGGCCTTCAGGATAAACTTC (SEQ ID NO: 725) |
| X. tropicalis | vpp1 | TALEN | P3 | TGCACACACATAACACGGTTC (SEQ ID NO: 726) |
| X. tropicalis | sox9 | TALEN | P1 | CTCAACTCTCTTCGCCAACTTTCT (SEQ ID NO: 727) |
| X. tropicalis | sox9 | TALEN | P2 | TGCATCAGAGAGGCGGTCAG (SEQ ID NO: 728) |
| X. tropicalis | sox9 | TALEN | P3 | TCTTGGCTGTACCGATACAGACC (SEQ ID NO: 729) |
| X. tropicalis | foxd3 | TALEN | P1 | GAGCGGCATCTGTGAGTTCATC (SEQ ID NO: 730) |
| X. tropicalis | foxd3 | TALEN | P2 | GACAATGGCAGTTTCCTCAGGA (SEQ ID NO: 731) |
| X. tropicalis | foxd3 | TALEN | P3 | TATCGAGGAGGCTGCCGATAC (SEQ ID NO: 732) |
| X. tropicalis | bip | TALEN | P1 | AAACCCTATTGAATTAGTTGGAGGC (SEQ ID NO: 733) |
| X. tropicalis | bip | TALEN | P2 | GCGTATTTGCTGCTGATGATGAT (SEQ ID NO: 734) |
| X. tropicalis | bip | TALEN | P3 | TCCCTTAACATGTGACTCCAAACC (SEQ ID NO: 735) |
| X. tropicalis | noggin287 | mismatch | Fw | CGCCAATTGGACATCACTGCTATATAG (SEQ ID NO: 736) |
| X. tropicalis | noggin287 | mismatch | Re | CGTTACATCTGGCGTAAAAGTAACACAG (SEQ ID NO: 737) |
| X. tropicalis | ets152 | mismatch | Fw | CCCTAAAACACAAACATCGTAGGGC (SEQ ID NO: 738) |
| X. tropicalis | ets152 | mismatch | Re | GTCCCTTTCCTTCCTTGGAGGATAC (SEQ ID NO: 739) |

The table lists the primers used in this study. The noggin 287 and ets152 are primers used for examining potential off-target sites identified by e-PCR (FIG. 20)

Detection of Heritable Mutations.

TALEN-injected *X. tropicalis* embryos were raised to sexual maturity. Male TALEN-targeted G₀ frogs were crossed with wild-type females, and F₁ embryos were collected at 48 h postfertilization. Genomic DNA was extracted from each embryo individually to assess mutagenesis at the TALEN-targeted site by PCR-based assays described above for detecting somatic mutations. The individual positive clones were confirmed by DNA sequencing. For F₁ embryos derived from ptf1a/P48-TALEN injected G₀ frogs, ptf1a/P48 mutations were detected by direct DNA sequencing after the TA cloning of the DNA fragments.

Results

TALENs Effectively Induce Targeted Gene Disruption in *Xenopus* Embryos.

Figure 15:
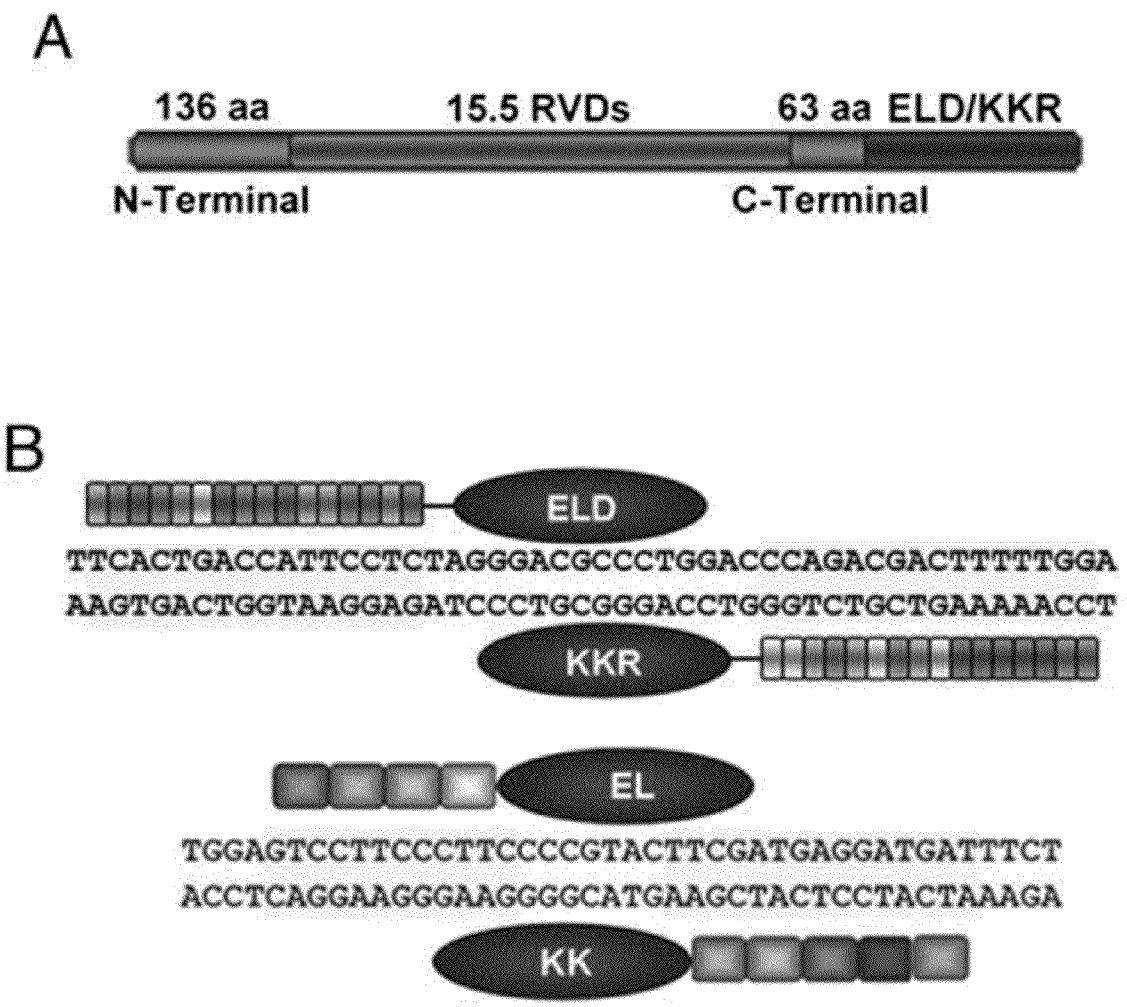
FIG. 15: Schematic drawing of TALENs and ZFNs and sequences of somatic mutations induced in *X. tropicalis* $G_0$ embryos. (A) Schematic drawing of TALEN with 15.5 RVDs located between 136-aa N-terminal and 63-aa C-terminal regions. The ELD and KKR Fok I nuclease domains are linked to the C terminus of the TALE monomer. (B) Schematic drawing of TALENs (Upper) and ZFNs (Lower) that target ptf1a/p48 (SEQ ID NOS:486-489). Recognition sequences are shaded. (C) DNA sequences targeted by noggin-(SEQ ID NO:490), ptf1a/p48-(SEQ ID NO:507), or ets1-TALENs (SEQ ID NO:517), and somatic mutations induced in *Xenopus* embryos (SEQ ID NOS:491-506, 508-516 and 518-539, respectively). Sequenced mutations are listed. The largest forward deletion (400 bp) and the largest backward deletion (403 bp) were found in ets1 of *X. tropicalis*. (D) noggin-(SEQ ID NO:540) and ptf1a/p48-(SEQ ID NO:546) ZFNs targeting sites and somatic mutations induced by these pairs of ZFNs (SEQ ID NOS:541-545 and 547-554, respectively). In C and D, mutated regions are shaded in gray, with dashes indicating deletions (Δ) and lowercase letters indicating insertions (+). The numbers in parentheses show the number of deleted or inserted base pairs, whereas numbers in square brackets show the frequencies of the mutation in the sequenced samples.

TALEN constructs were constructed using the Golden Gate assembly method with the following RVD cipher codes: NI for A, NG for T, HD for C, and NN for G (Cermak T, et al., 2011). The C-terminal TALE repeat was shortened to 63 aa (Miller J C, et al., 2011). The TALE repeats targeting upstream and downstream effector binding elements (EBEs) were then subcloned into pCS2+ vector harboring the modified Fok I nuclease domains ELD and KKR (Doyon Y, et al., 2011), respectively (FIG. 15a, corresponding to original FIG. 1A and FIG. 13). ELD and KKR have less off-target effects and higher efficiency because of compulsory heterodimer formation (Doyon Y, et al., 2011; Cade L, et al., 2012). Thus, through dimerization of ELD and KKR, a pair of TALENs that binds to upstream and downstream EBEs of a given site is expected to cleave the DNA in the spacer region between the two EBEs (FIG. 15b).

First, three genes of *X. tropicalis* were targeted, noggin, ptf1a/p48, and ets1 (FIG. 15). noggin (Young J J, et al., 2011) and ptf1a/p48 were also targeted by the corresponding ZFNs for a side-by-side comparison with TALENs. The TALEN EBE sequences of noggin and ptf1a/p48 were located in the adjacent regions to the corresponding ZFN targeting sequences (FIG. 16, corresponding to FIG. S2). The target site in the third exon of *X. tropicalis* ets1 is identical to the corresponding site in *X. laevis* (FIG. 16), and therefore the targeting efficiency of ets1-TALENs was evaluated in both species. The mix containing a pair of TALEN or ZFN mRNAs was injected into one-cell stage embryos of *X. tropicalis* or *X. laevis*.

Forty-eight hours after injection, the inventors randomly pooled five embryos injected with each pair of TALENs/ZFNs, extracted genomic DNA, amplified the targeted region, subcloned the fragments, and examined multiple colonies by PCR. As illustrated in FIG. 14a, primers 1 and 3 bridge both EBE regions, whereas primers 2 and 3 link the spacer region and the downstream EBE. PCR products of primers 1 and 3 were transferred into the vector pMD18-T (Takara) by TA cloning, and single colonies were examined by PCR using both 1/3 and 2/3 primer pairs. If primer pair 1/3 generates a PCR fragment, whereas primer pair 2/3 fails to do so, it suggests that the targeted gene is disrupted by the TALENs (FIG. 14b). Putative disrupted colonies were checked by DNA sequencing, and the targeting efficiency was determined as the ratio of mutant to total colonies. All tested TALENs and ZFNs were effective at disrupting the targeted genes in *Xenopus* embryos (FIG. 15c-d). It was found that the targeting efficiency of all pairs of TALENs was profound with the highest TALEN-induced mutation ratio of 90.0% (18/20) for noggin when 800 pg of mRNA (400 pg of left and 400 pg of right monomer mRNA) was injected (FIGS. 15c and 17a, corresponding to FIG. 3A). Similarly, the targeting efficiency for ptf1a/p48 was about 80.3% (37/46) (FIGS. 15c and 17b). By contrast, at the same injection dose, the corresponding ZFNs caused higher levels of dead and deformed embryos, whereas at a lower dose the targeting efficiency was lower (FIGS. 15d and 17a-b). The targeting efficiency of ets1-TALENs in *X. laevis* injected with 500 pg of mRNA was similar to that in *X. tropicalis* (FIGS. 15c and 17c). Notably, a 403-bp fragment was deleted in ets1 of *X. tropicalis*, which was the largest deletion induced by TALENs in this study (FIG. 15c).

TALENs were next designed to specifically disrupt the hhex, vpp1, foxd3, sox9, and grp78/bip genes (FIGS. 18 and 19, corresponding to FIGS. S3 and S4). These TALENs were also highly efficient in the generation of somatic mutations at the targeted loci with 82.6% (19/23) for hhex, 87.0% (20/23) for vpp1, 95.7% (22/23) for foxd3, 85.0% (17/20) for sox9, and 61.9% (13/21) for grp78/bip, respectively (FIG. 18). Collectively, these data indicate that TALENs are powerful and effective tools for conducting mutagenesis in both *X. tropicalis* and *X. laevis*. The high frequencies observed suggested that both alleles were disrupted in many cells of the injected embryos.

High-dose injection of TALEN mRNA may cause nonspecific defects in *Xenopus* embryos. As shown in FIG. 17d-f, high-dose injections of TALENs led to abnormal morphology in a portion of the embryos, which could be reduced by decreasing the injection dose. Abnormalities apparently due to the toxicity of TALENs include curled axis, repression of head structures including eyes, and loss of pigment (FIG. 17g). Such abnormal tadpoles usually could not complete metamorphosis.

Specificity is essential for any gene-editing approach. To examine whether the TALENs have off-target effects, e-PCR (www.ncbi.nlm.nih.gov/sutils/e-per) was utilized to scan the *X. tropicalis* genomic sequence to identify potential off-target sites potentially targeted by noggin, ets1, and ptf1a/p48 TALENs (FIG. 20, corresponding to FIG. S5). The criteria for determining off-target sites were that up to six nonidentical bases occur in the two EBEs, 2-bp gaps in the two EBEs, and the spacer between the two putative EBE regions is <100 bp because it was suggested that longer spacers interfere with Fok I dimerization (Miller J C, et al., 2011). PCR was used to amplify the identified potential off-target regions using genomic DNA from TALEN-injected embryos as template; no mutations were found at these sites by DNA sequencing. These data suggest that TALENs have high specificity for their target sequences.

Phenotypes of Somatic Mutations Induced by TALENs in *X. tropicalis*.

That growth and development of *X. tropicalis* embryos injected with TALENs was followed to monitor functional consequences of the gene disruption. The ptf1a/p48-TALEN targeted froglets (800-pg injection dose) showed smaller body size compared with wild-type froglets. Twelve froglets were dissected for anatomical analysis, and all of them showed agenesis of the pancreas (FIG. 21a-b, corresponding to FIGS. 4 A and B). The observed phenotypes of pancreas are reminiscent of those seen in ptf1a/p48−/− mice (Krapp A, et al., 1998). PCR analysis and further DNA sequencing of genomic DNA extracted from hindlimb tissues of a $G_0$ *X. tropicalis* froglet showing the described phenotypes confirmed the TALEN-induced mutations at ptf1a/p48 loci (FIG. 21c). It also indicated a high ratio of ptf1a/p48 disruption (87.0%; 20/23) in somatic cells, suggesting that both alleles of ptf1a/p48 were disrupted in this frog. Furthermore, multiple alleles were observed, indicating that this $G_0$ founder animal was highly mosaic for the disrupted locus. The high ratio of gene disruption induced by TALENs could provide an immediate phenotype assessment for gene-specific knockout that is usually time consuming. In line with our observation of pancreas agenesis in adult ptf1a/p48-TALEN-injected $G_0$ frogs, the expression of pdip, an early marker gene specific to dorsal and ventral pancreatic buds (Afelik S, et al., 2004), was reduced in a portion of ptf1a/p48-TALEN-injected embryos compared with those in control uninjected or ets1-TALEN-injected embryos (FIG. 21d-g), further suggesting the specificity of pancreatic phenotype induced by direct injection of ptf1a/p48 TALENs.

Mutations Induced by TALENs Are Heritable in *X. tropicalis*.

Figure 23:
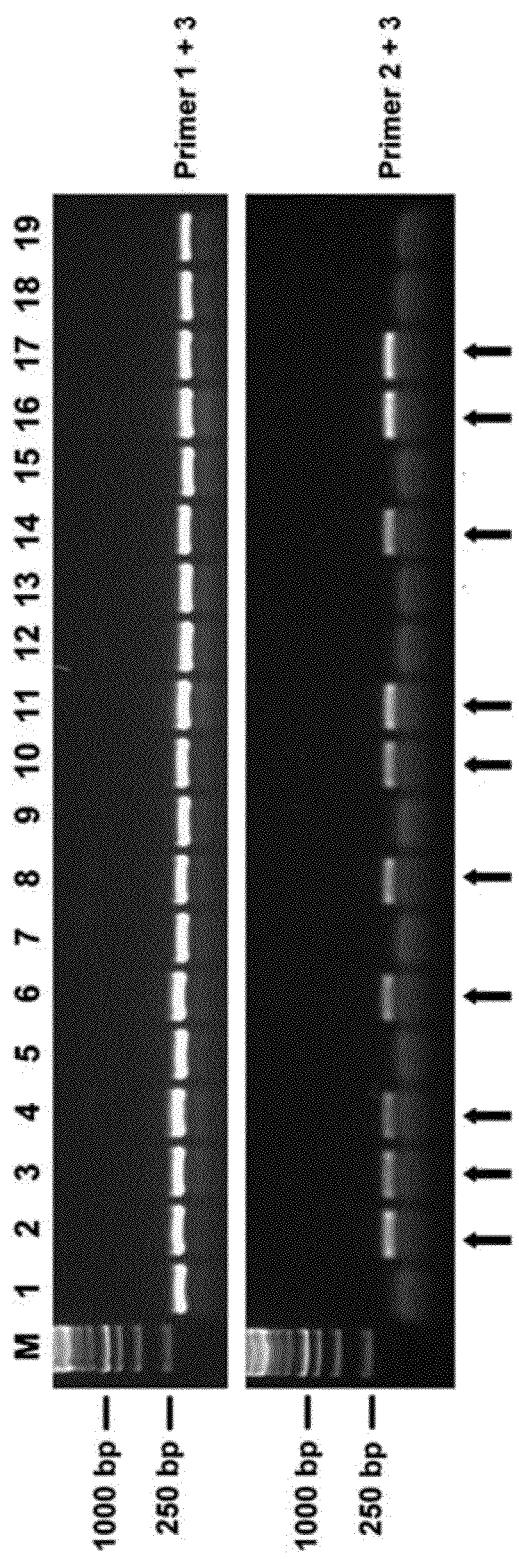
FIG. 23: Colony PCR showing heritable mutation in ets1-TALEN-targeted $F_1$ embryos. A representative gel indicating colonies carrying indel mutations or wildtype ets1 sequence (arrow). See FIG. 14, and Table 6 for method and primer sequences.

Successful germ-line transmission is essential for establishment of knockout lines. The ets1- and ptf1a/p48-TALEN-targeted $G_0$ frogs were mated with wild-type frogs to examine germ-line transmission. Twenty embryos for ets1 from three independent crosses and 15 embryos for ptf1a/p48 from two independent crosses were collected, and genomic DNA was extracted from each individual embryo to assess mutagenesis at the TALEN-targeted site by the PCR and subcloning-sequencing assays described above. Nineteen of 20 or 13 of 15 $F_1$ embryos carried TALEN-induced mutations in the ets1 or ptf1a/p48 gene (FIGS. 22*a-b* and 23, corresponding to FIGS. 5*a* and *b* and S6). This high proportion indicates that a majority of gametes in the $G_0$ frogs was mutant. As can be predicted for viable $F_1$ offspring, the gene-disrupted embryos were heterozygous as revealed by PCR (ets1-TALEN targeted $F_1$ embryos; FIG. 23), or by DNA sequencing (ptf1a/p48-TALEN-targeted $F_1$ embryos). These results indicate that TALEN-induced gene disruption in *Xenopus* is heritable.

Discussion

The *X. laevis* and *X. tropicalis* are important model organisms for studies in cell and developmental biology. However, the lack of methodologies for targeted mutagenesis has impeded their application to studies on the genetic control of development. This study, established modified procedures for generating targeted mutations in *Xenopus* embryos using TALENs and found that such mutations are heritable.

Figure 17:
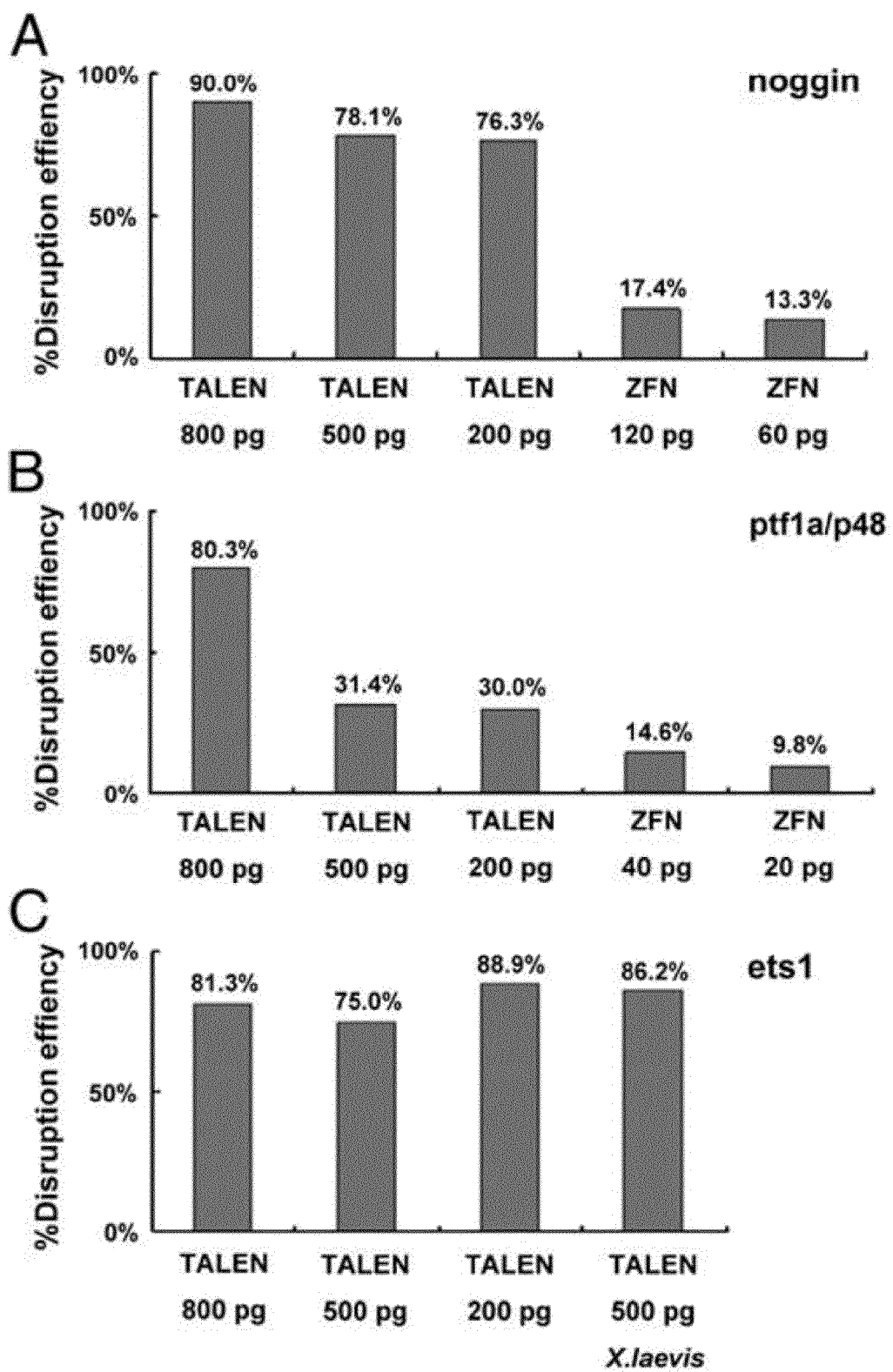
FIG. 17: Frequencies of mutations and abnormal embryos induced by the indicated TALENs or ZFNs in *Xenopus*. Mutation frequencies were assayed as shown in FIG. 14. Only the mutation ratios induced by lower doses of ZFNs are shown because higher doses (200, 500, and 800 pg) resulted in dead or malformed embryos. (A-C) Frequencies of targeted mutagenesis induced by TALENs or ZFNs for the genes and at the doses indicated in the panels. All data refer to *X. tropicalis* except in C where *X. laevis* results are also shown. (D-F) Percentage of normal, abnormal, and dead *X. tropicalis* embryos injected with the indicated doses of TALEN or ZFN mRNAs. The injected embryos were inspected at 48 h postfertilization (about stage 41). (G) Overall morphology of *X. tropicalis* embryos injected with TALEN mRNAs directed against the indicated gene at stage 41. Curled axis, repression of head structures including eyes, and loss of pigments were observed. Such abnormal tadpoles usually could not complete metamorphosis.
Figure 17:
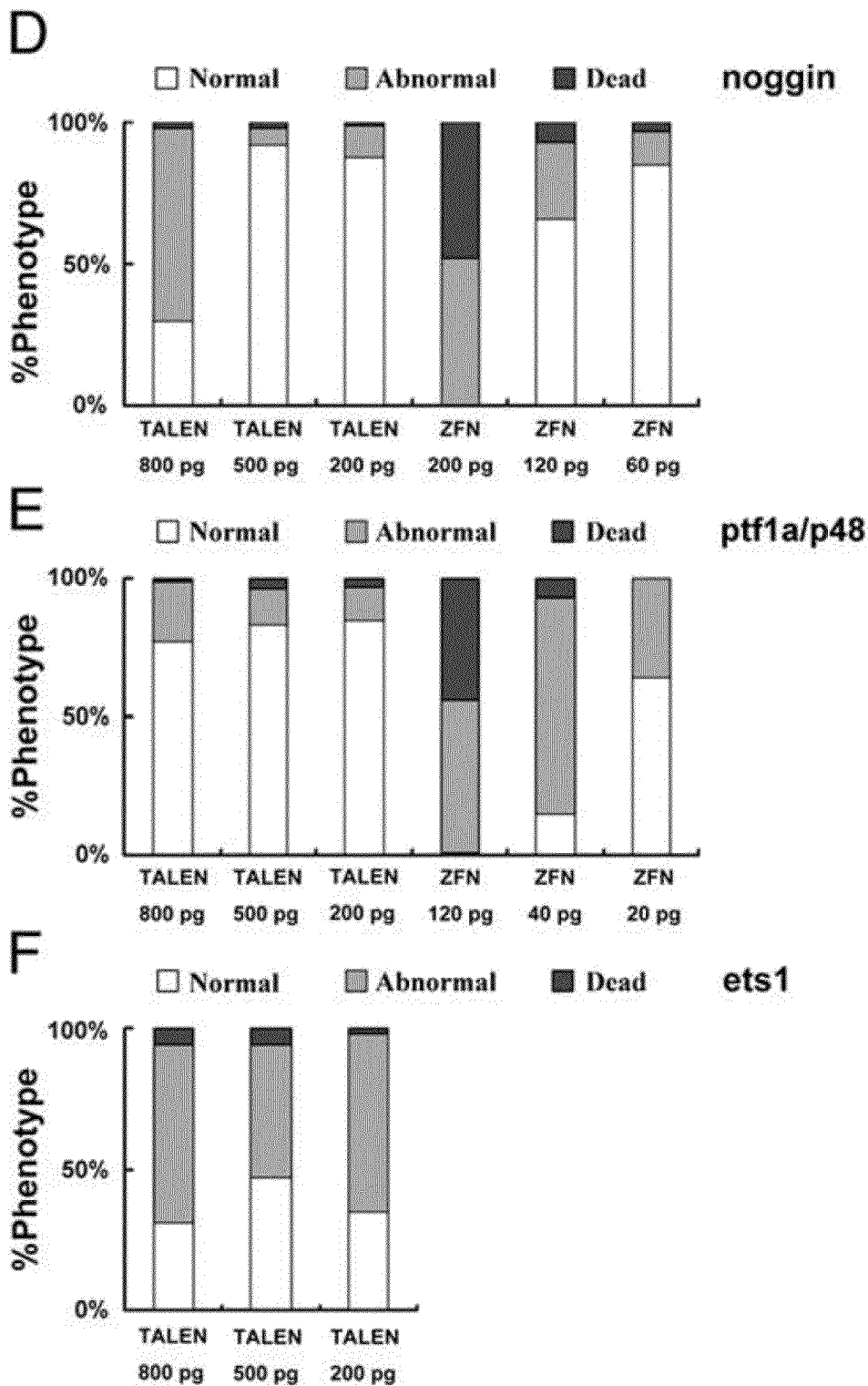
Figure 17:
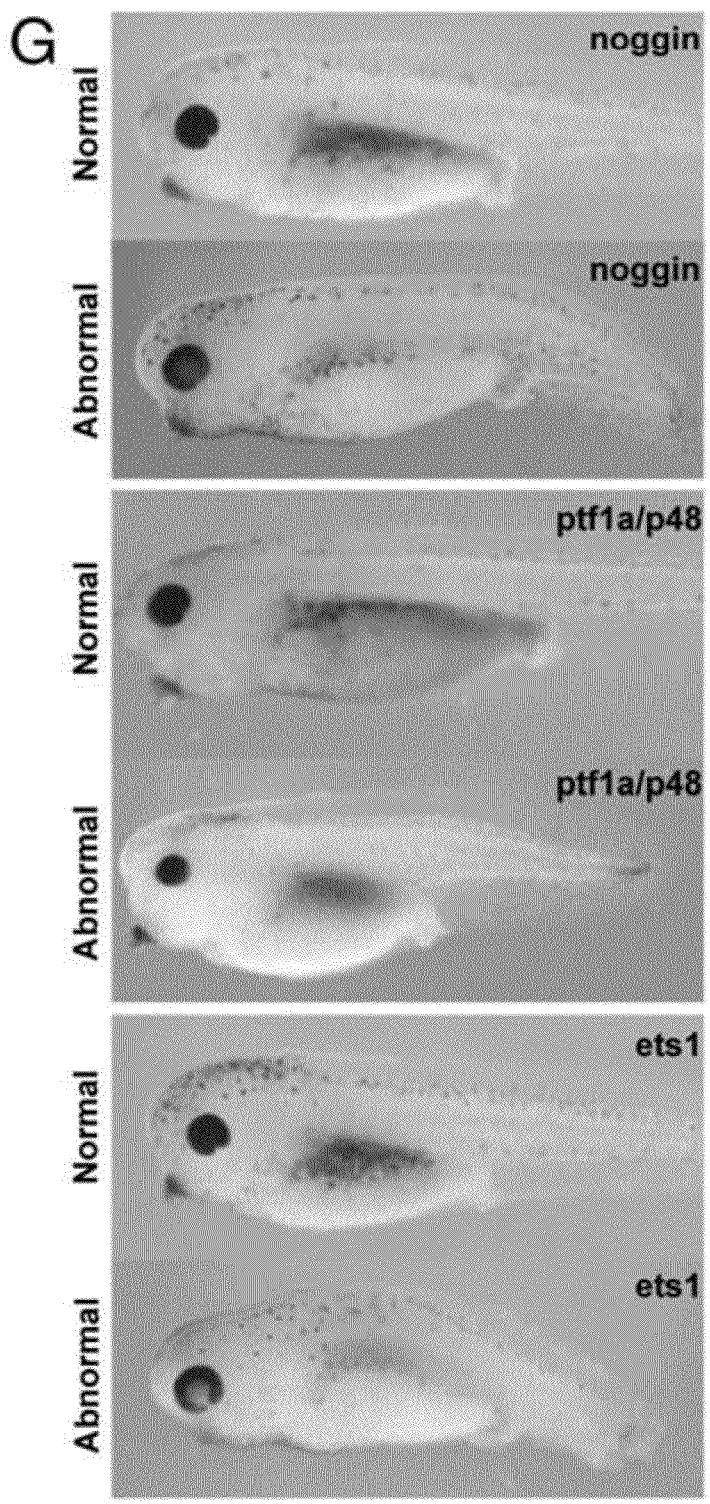

Based on the Golden Gate method (Cermak T, et al., 2011), TALEN arrays were assembled to target selected gene sequences, and heterodimeric ELD/KKR Fok I variants were used for gene editing. ELD/KKR are derived from the Fok I nuclease domain and are reported to have higher specificity (Doyon Y, et al., 2011) and less toxicity (Cade L, et al., 2012) than Fok I homodimers. Although it was reported previously that these modified Fok I domains exhibited decreased cleavage efficiency in human cells, recent studies indicated that ELD/KKR showed higher activities than wild-type Fok I in zebrafish embryos, and that TALENs containing EL/KK or ELK/KKR induced a similar rate of deformed and dead embryos in zebrafish (Cade L, et al., 2012). The ZFN pairs tested contained EL and KK, respectively. High-dose injection of these ZFNs mRNA led to high proportions of abnormal and dead embryos, whereas low doses of ZFN mRNAs had reduced efficiency of targeted gene disruption. In contrast, *Xenopus* embryos seemed tolerant to quite high doses of TALEN mRNAs (FIG. 17).

A number of studies suggested that T at site 0 is significant for target site recognition and binding by TALENs (Boch J, et al., 2009; Moscou M J, et al., 2009; Mahfouz M M, et al., 2011), and that a 14- to 16-bp spacer is optimal for DNA cleavage (Miller J C, et al., 2011). The RVDs of HD, NI, and NG have a high preference for C, A, and T, respectively, but NN can recognize both G and A (Boch J, et al., 2009; Scholze H, et al., 2010). Therefore EBEs with fewer G residues were chosen to avoid the potential off-target effects caused by this TALE ambiguity. TALEN targeting sequences were chosen according to the following criteria: (i) nucleotide T is at position 0 and the EBE sequence follows this T; (ii) the length of both EBE sequences is 16 bp, and the spacer sequence is around 16 bp; (iii) minimize G residues in EBE sequences; (iv) select EBEs in an exon. Following these rules, eight pairs of TALENs were designed to target eight genes, and all showed high efficiencies of up to 95.7% in generating somatic mutations at the targeted sites in *Xenopus* embryos. Thus, these results strongly suggest that TALENs can target most of loci in the *Xenopus* genome.

Moreover, the germ-line transmission rate of TALEN-induced mutations was efficient at the two examined loci, ets1 and ptf1a/p48, indicating that TALEN-induced mutations are heritable in *Xenopus*. Taken together, these results indicate that these procedures allow simple, robust, and efficient generation of targeted mutations in *Xenopus*.

Although the PCR-based method for detecting mutagenesis is reliable, it may underestimate the mutation rate. For example, if the indel mutations were outside the primer 3 binding site, the PCR would miss such mutations. An additional primer 4 that overlaps the joint region of the downstream EBE site will help overcome this shortcoming. Two sets of PCRs with primers 2 and 3, and primers 1 and 4 might be able to detect all indel mutations. Because the mutation rates induced by our TALEN system are generally high, direct sequencing may also be feasible after TA cloning.

A number of studies indicate that TALENs are highly specific for targeted gene editing (Sander J D, et al., 2011; Scholze H, et al., 2010). In this study, using e-PCR to perform BLAST searches, potential off-target sites were identified, but no mutation was found at these sites by DNA sequencing.

Although the TALEN-targeted $G_0$ embryos were mosaic (FIG. 15), the high frequency of somatic mutation induced by our TALEN system resulted in obvious phenotypes in $G_0$ founders. Agenesis of the pancreas was observed in ptf1a/p48-TALEN targeted $G_0$ frogs, which was similar to that of ptf1a/p48 knockout mice. It would be interesting to compare phenotypes of $G_0$ embryos with those induced by morpholinos. However, the high mutation load may interfere with derivation of a mutant line, which could be avoided by injection of TALENs at lower doses. In addition, TALENs may be used to mediate homologous recombination in the *Xenopus* genome or the genome of another organism.

Figure 21:
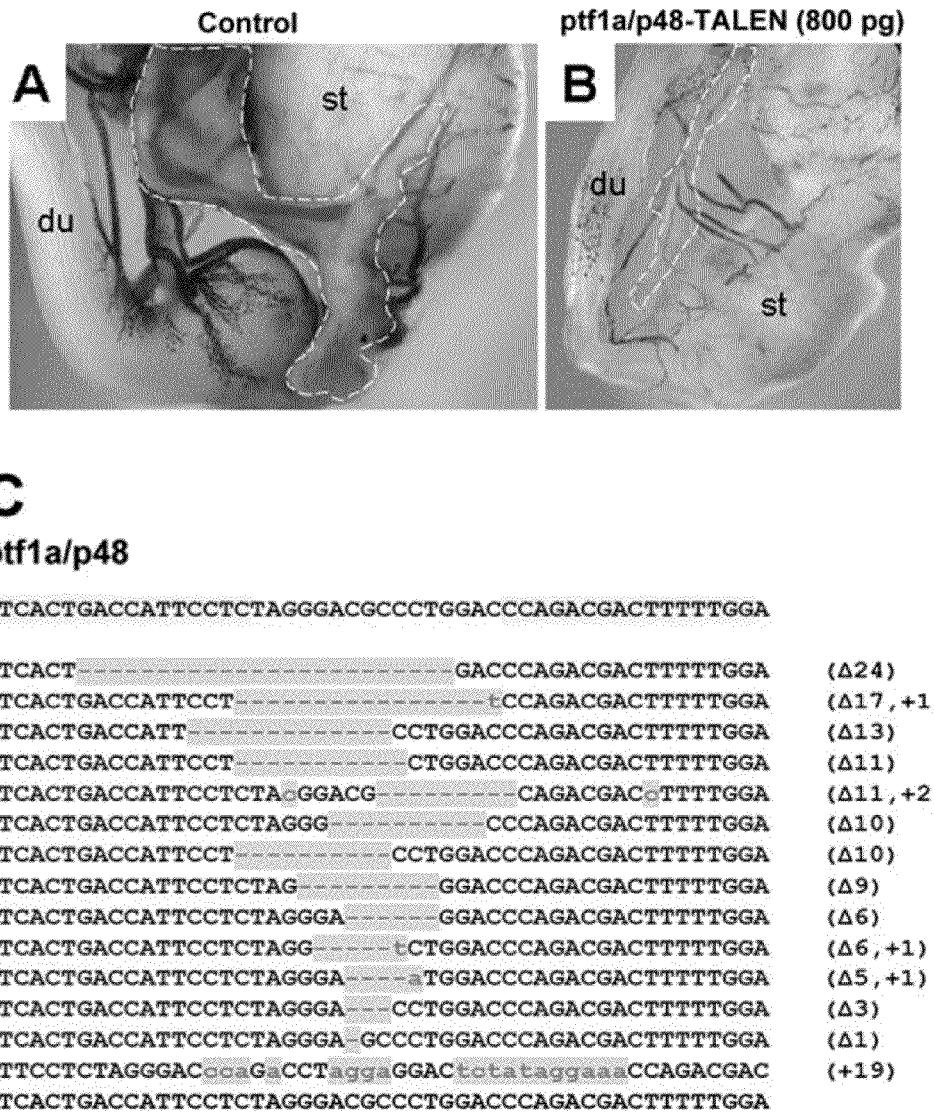
FIG. 21: Phenotypes of ptf1a/p48-TALEN targeted *X. tropicalis*. (A and B) Anatomical analysis revealed visceral abnormalities such as much reduced pancreas in ptf1a/p48-TALEN-injected $G_0$ froglets. The pancreas is outlined by dashed lines. (C) DNA sequencing of genomic DNA (SEQ ID NO:621) extracted from hindlimb tissue dissected from a froglet showing a phenotype similar to that in B confirmed the gene disruption at the ptf1a/p48 locus (SEQ ID NOS:622-635 and 621, respectively) (20/23) (du, duodenum; st, stomach). (D-F) Whole-mount in situ hybridization of pancreas marker pdip in *X. tropicalis* tadpoles injected with the indicated TALEN mRNAs. ptf1a/p48-TALENs, but not ets1-TALENs, induced repression of pancreas bud formation. (D) Uninjected control embryos, (E) ptf1a/p48-TALENinjected embryos (800 pg), and (F) ets1-TALEN-injected embryos (800 pg). (G) Summary of the phenotypes shown in D-F. The TALEN mRNAs were injected into the animal pole region at the one-cell stage; embryos were analyzed at stage 40.
Figure 21:

The high mosaicism in $G_0$ adult frogs was expected and confirmed by FIG. 21. TALENs can disrupt both alleles of a gene and generate two different mutant alleles after NHEJ in somatic cells. Because indel mutations usually are found in the spacer region, the TALEN pair could bind to their EBE sites again even after NHEJ-mediated DNA repair, inducing additional mutations as cells proliferate during development. Therefore, it is possible to observe a large diversity of mutants at the targeted loci of $G_0$ frogs in both somatic and germ-line cells. In some cases, it may therefore be advantageous to apply the TALENs at a lower dose to generate mutant lines.

It is understood that the examples and embodiments described herein are for illustrative purposes only and that various modifications or changes in light thereof will be suggested to persons skilled in the art and are to be included within the spirit and purview of this application and scope of the appended claims.

The term "a" or "an" is intended to mean "one or more." The term "comprise" and variations thereof such as "comprises" and "comprising," when preceding the recitation of a step or an element, are intended to mean that the addition of further steps or elements is optional and not excluded. All publications, patents, patent applications, and nucleotide and amino acid sequence accession numbers cited herein are hereby incorporated by reference in their entirety for all purposes.

REFERENCES

1. Afelik S, Chen Y, Pieler T: Pancreatic protein disulfide isomerase (XPDIp) is an early marker for the exocrine lineage of the developing pancreas in *Xenopus laevis* embryos. *Gene Expr Patterns* 4:71-76 (2004)
2. Bartel, D. P. MicroRNAs: target recognition and regulatory functions. *Cell* 136, 215-233 (2009).
3. Boch J, Bonas U: *Xanthomonas* AvrBs3 family-type III effectors: Discovery and function. *Annu Rev Phytopathol* 48:419-436 (2010).

4. Boch, J. et al.: Breaking the code of DNA binding specificity of TAL-type III effectors. *Science* 326, 1509-1512 (2009).
5. Bogdanove A J, Schornack S, Lahaye T: TAL effectors: finding plant genes for disease and defense. *Curr Opin Plant Biol* 13:394-401 (2010).
6. Bogdanove, A. J. & Voytas: D. F. TAL effectors: customizable proteins for DNA targeting. *Science* 333, 1843-1846 (2011).
7. Cade L, et al.: Highly efficient generation of heritable zebrafish gene mutations using homo- and heterodimeric TALENs. *Nucleic Acids Res* 40(16):8001-8010 (2012).
8. Cermak, T. et al.: Efficient design and assembly of custom TALEN and other TAL effector-based constructs for DNA targeting. *Nucleic Acids Res* 39, e82 (2011).
9. Christian, M. et al.: Targeting DNA double-strand breaks with TAL effector nucleases. *Genetics* 186, 757-761 (2010).
10. Deng, D. et al.: Structural basis for sequence-specific recognition of DNA by TAL effectors. *Science* 335, 720-723 (2012).
11. Doyon, Y. et al.: Enhancing zinc-finger-nuclease activity with improved obligate heterodimeric architectures. *Nat Methods* 8, 74-79 (2011).
12. Foley, J. E. et al.: Targeted mutagenesis in zebrafish using customized zinc-finger nucleases. *Nat Protoc* 4, 1855-1867 (2009).
13. Hockemeyer, D. et al.: Genetic engineering of human pluripotent cells using TALE nucleases. *Nat Biotechnol* 29, 731-734 (2011).
14. Huang, P. et al.: Heritable gene targeting in zebrafish using customized TALENs. *Nat Biotechnol* 29, 699-700 (2011).
15. Isalan, M. Zinc-finger nucleases: how to play two good hands. *Nat Methods* 9, 32-34 (2012).
16. Kim Y G, Cha J, Chandrasegaran S, Hybrid restriction enzymes: Zinc finger fusions to Fok I cleavage domain. *Proc Natl Acad Sci USA* 93:1156-1160 (1996).
17. Krapp A, et al.: The bHLH protein PTF1-p48 is essential for the formation of the exocrine and the correct spatial organization of the endocrine pancreas. *Genes Dev* 12:3752-3763 (1998).
18. Lei, Y., Guo, X., Liu, Y., Cao, Y., Deng, Y., Chen, X., Cheng, C. H. K., Dawid, I. B., Chen, Y., Zhao, H. Efficient Targeted gene disruption of *Xenopus* embryos using engineered transcription activator-like effector nucleases (TALENS). *Proc Natl Acad Sci USA* 109:17484-89 (2012).
19. Maeder, M. L., Thibodeau-Beganny, S., Sander, J. D., Voytas, D. F. & Joung, J. K. Oligomerized pool engineering (OPEN): an 'open-source' protocol for making customized zinc-finger arrays. *Nat Protoc* 4, 1471-1501 (2009).
20. Mahfouz, M. M. et al.: De novo-engineered transcription activator-like effector (TALE) hybrid nuclease with novel DNA binding specificity creates double-strand breaks. *Proc Natl Acad Sci USA* 108, 2623-2628 (2011).
21. Mak, A. N., Bradley, P., Cernadas, R. A., Bogdanove, A. J. & Stoddard, B. L.: The crystal structure of TAL effector PthXo1 bound to its DNA target. *Science* 335, 716-719 (2012).
22. Mani M, Smith J, Kandavelou K, Berg J M, Chandrasegaran S: Binding of two zinc finger nuclease monomers to two specific sites is required for effective doublestrand DNA cleavage. *Biochem Biophys Res Commun* 334:1191-1197 (2005).
23. Miller J C, et al.: An improved zinc-finger nuclease architecture for highly specific genome editing. *Nat Biotechnol* 25:778-785 (2007).
24. Miller, J. C. et al.: A TALE nuclease architecture for efficient genome editing. *Nat Biotechnol* 29, 143-148 (2011).
25. Moscou, M. J. & Bogdanove, A. J.: A simple cipher governs DNA recognition by TAL effectors. *Science* 326, 1501 (2009).
26. Mussolino, C. & Cathomen: T. TALE nucleases: tailored genome engineering made easy. *Curr Opin Biotechnol* (2012).
27. Sander, J. D. et al.: Targeted gene disruption in somatic zebrafish cells using engineered TALENs. *Nat Biotechnol* 29, 697-698 (2011).
28. Sander, J. D. et al.: Selection-free zinc-finger-nuclease engineering by context-dependent assembly (CoDA). *Nat Methods* 8, 67-69 (2011).
29. Scholze H, Boch J (2010); TAL effector-DNA specificity. *Virulence* 1:428-432 (2010).
30. Smith J, et al.: Requirements for double-strand cleavage by chimeric restriction enzymes with zinc finger DNA-recognition domains. *Nucleic Acids Res* 28:3361-3369 (2000).
31. Tesson, L. et al.: Knockout rats generated by embryo microinjection of TALENs. *Nat Biotechnol* 29, 695-696 (2011).
32. Thatcher, E. J., Bond, J., Paydar, I. & Patton, J. G.: Genomic organization of zebrafish microRNAs. *BMC Genomics* 9, 253 (2008).
33. Wood, A. J. et al.: Targeted genome editing across species using ZFNs and TALENs. *Science* 333, 307 (2011).
34. Young J J, et al.: Efficient targeted gene disruption in the soma and germ line of the frog *Xenopus tropicalis* using engineered zinc-finger nucleases. *Proc Natl Acad Sci USA* 108:7052-7057 (2011).
35. Zhao H, Han D, Dawid I B, Pieler T, Chen Y: Homeoprotein hhex-induced conversion of intestinal to ventral pancreatic precursors results in the formation of giant pancreata in *Xenopus* embryos. *Proc Natl Acad Sci USA* 109: 8594-8599 (2012).
36. Zhao H, Tanegashima K, Ro H, Dawid I B: Lrig3 regulates neural crest formation in *Xenopus* by modulating Fgf and Wnt signaling pathways. *Development* 135:1283-1293 (2008).

SEQUENCE LISTING (739 sequences)

SEQ ID NO: 1 - protein, 136 aa, Artificial Sequence
  synthetic first segment N-terminal portion of coding region for Xanthomonas spp. transcription activator-like effector (TALE) with deleted Type III-dependent plant cell translocation sequence deleted (deltaN152)
VDLRTLGYSQQQQEKIKPKVRSTVAQHHEALVGHGFTHAHIVALSQHPAALGTVAVTYQHIITALPEATHEDIVGVGKQWSGARALEALLTDAGELRGPPLQLDTGQLVKIAKRGGVTAMEAVHASRNALTGAPLN

SEQ ID NO: 2 - protein, 63 aa, Artificial Sequence
  synthetic second segment truncated C-terminal domain of Xanthomonas spp. transcription activator-like effector (TALE) (C63)
SIVAQLSRPDPSLAALTNDHLVALACLGGRPALDAVKKGLPHAPALIKRTNRRIPERTSHRVA

SEQ ID NO: 3 - protein, 198 aa, Artificial Sequence
  synthetic modified FokI nuclease catalytic domain, KKR FokI catalytic domain
GSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVKENQTRNKHINPNEWWKVYPSSVTEFKFLFVSGHFKGNYKAQLTRLNRKTNCNGAVLSVEELLIGGEMIKAGTLTLEEVRRKFNNGEINF

SEQ ID NO: 4 - protein, 198 aa, Artificial Sequence
  synthetic modified FokI nuclease catalytic domain, ELD FokI catalytic domain
GSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMERYVEENQTRDKHLNPNEWWKVYPSSVTEFKFLFVSGHFKGNYKAQLTRLNHITNCNGAVLSVEELLIGGEMIKAGTLTLEEVRRKFNNGEINF

SEQ ID NO: 5 - DNA, 5768 bp, Artificial Sequence
  synthetic expression cassette plasmid pCS2-TALENs-KKR
  CDS (91)...(1783): TALEN
cgccattctgcctggggacgtcggagcaagcttgatttaggtgacactatagaatacaagctacttgttctttttgcaggatctgccaccatggctccaaagaagaagcgtaaggtagactacaaagaccatgacggtgattataaagatcatgacatcgattacaaggatgacgatgacaagggtaccgtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctggagacgggcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgagtaccgggccccccctcgaggtcctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccaccggtcgtctccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccggatcccaactagtcaaaagtgaactggaggagaagaaatctgaacttcgtcataaattgaaatatgtgcctcatgaatatattgaattaattgaaattgccagaaattccactcaggatagaattcttgaaatgaaggtaatggaattttttatgaaagtttatggatatagaggtaaacatttgggtggatcaaggaaaccggacggagcaatttatactgtcggatctcctattgattacggtgtgatcgtggatactaaagcttatagcggaggttataatctgccaattggccaagcagatgaaatgcaacgatatgtcaaagaaaatcaaacacgaaacaaacatatcaaccctaatgaatggtggaaagtctatccatcttctgtaacggaatttaagtttttatttgtgagtggtcactttaaaggaaactacaaagctcagcttacacgattaaatcgcaagactaattgtaatggagctgttcttagtgtagaagagcttttaattggtggagaaatgattaaagccggcacattaaccttagaggaagtgaggcggaaatttaataacggcgagataaacttttaatctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaattcgcggccgcggcgccaatgcattgggcccggtacgtacccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagtcgaccatagccaattcaatatggcgtatatggactcatgccaattcaatatggtggatctggacctgtgccaattcaatatggcgtatatggactcgtgccaattcaatatggtggatctggaccccagccaattcaatatggcggacttggcaccatgccaattcaatatggcggacttggcactgtgccaactggggaggggtctacttggcacggtgccaagtttgaggaggggtcttggccctgtgccaagtccgccatattgaattggcatggtgccaataatggcggccatattggctatatgccaggatcaatatataggcaatatccaatatggccctatgccaatatggctattggccaggttcaatactatgtattggccctatgccatatagtattccatatatgggttttcctattgacgtagatagcccctcccaatgggcggtcccatataccatatatggggcttcctaataccgcccatagccactcccccattgacgtcaatggtctctatatatggtctttcctattgacgtcatatgggcggtcctattgacgtatatggcgcctcccccattgacgtcaattacggtaaatggcccgcctggctcaatgcccattgacgtcaataggaccacccaccattgacgtcaatgggatggctcattgcccattcatatccgttctcacgccccctattgacgtcaatgacggtaaatggcccacttggcagtacatcaatatctattaatagtaacttggcaagtacattactattggaaggacgccagggtacattggcagtactcccattgacgtcaatggcggtaaatggcccgcgatggctgccaagtacatccccattgacgtcaatggggaggggcaatgacgcaaatgggcgttccattgacgtaaatgggcggtaggcgtgcctaatgggaggtctatataagcaatgctcgtttagggaac

SEQ ID NO: 6 - DNA, 5768 bp, Artificial Sequence
  synthetic expression cassette plasmid pCS2-TALENs-ELD
  CDS (91)...(1783): TALEN
cgccattctgcctggggacgtcggagcaagcttgatttaggtgacactatagaatacaagctacttgttctttttgcaggatctgccaccatggctccaaagaagaagcgtaaggtagactacaaagaccatgacggtgattataaagatcatgacatcgattacaaggatgacgatgacaagggtaccgtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctggagacgggcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgagtaccgggccccccctcgaggtcctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccaccggtcgtctccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccggatcccaactagtcaaaagtgaactggaggagaagaaatctgaacttcgtcataaattgaaatatgtgcctcatgaatatattgaattaattgaaattgccagaaattccactcaggatagaattcttgaaatgaaggtaatggaattttttatgaaagtttatggatatagaggtaaacatttgggtggatcaaggaaaccggacggagcaatttatactgtcggatctcctattgattacggtgtgatcgtggatactaaagcttatagcggaggttataatctgccaattggccaagcagatgaaatggagcgatatgtcgaagaaaatcaaacacgagataaacatctcaaccctaatgaatggtggaaagtctatccatcttctgtaacggaatttaagtttttatttgtgagtggtcactttaaaggaaactacaaagctcagcttacacgattaaatcatatcactaattgtaatggagctgttcttagtgtagaagagcttttaattggtggagaaatgattaaagccggcacattaaccttagaggaagtgaggcggaaatttaataacggcgagataaacttttaatctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaattcgcggccgcggcgccaatgcattgggcccggtacgtacccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagtcgaccatagccaattcaatatggcgtatatggactcatgccaattcaatatggtggatctggacctgtgccaattcaatatggcgtatatggactcgtgccaattcaatatggtggatctggaccccagccaattcaatatggcggacttggcaccatgccaattcaatatggcggacttggcactgtgccaactggggaggggtctacttggcacggtgccaagtttgaggaggggtcttggccctgtgccaagtccgccatattgaattggcatggtgccaataatggcggccatattggctatatgccaggatcaatatataggcaatatccaatatggccctatgccaatatggctattggccaggttcaatactatgtattggccctatgccatatagtattccatatatgggttttcctattgacgtagatagcccctcccaatgggcggtcccatataccatatatggggcttcctaataccgcccatagccactcccccattgacgtcaatggtctctatatatggtctttcctattgacgtcatatgggcggtcctattgacgtatatggcgcctcccccattgacgtcaattacggtaaatggcccgcctggctcaatgcccattgacgtcaataggaccacccaccattgacgtcaatgggatggctcattgcccattcatatccgttctcacgccccctattgacgtcaatgacggtaaatggcccacttggcagtacatcaatatctattaatagtaacttggcaagtacattactattggaaggacgccagggtacattggcagtactcccattgacgtcaatggcggtaaatggcccgcgatggctgccaagtacatccccattgacgtcaatggggaggggcaatgacgcaaatgggcgttccattgacgtaaatgggcggtaggcgtgcctaatgggaggtctatataagcaatgctcgtttagggaac

SEQ ID NO: 7 - DNA, 1643 bp, Artificial Sequence
  synthetic customized TALEN construct Gria3aL, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 8 - DNA, 1640 bp, Artificial Sequence
  synthetic customized TALEN construct Gria3aR, transcription activator-like (TAL) effector DNA-binding domain
aacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcctgaccccggaccaagtggtggctatcgccagccacgatggcggcaagcaagcgctcgaaagcattgtggcccagctgagccggcctgatccggcgttggccgcgttgac

SEQ ID NO: 9 - DNA, 1541 bp, Artificial Sequence
  synthetic customized TALEN construct TnikbL, transcription activator-like (TAL) effector DNA-binding domain
aacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgac

SEQ ID NO: 10 - DNA, 1643 bp, Artificial Sequence
  synthetic customized TALEN construct TnikbR, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgac

SEQ ID NO: 11 - DNA, 1643 bp, Artificial Sequence
  synthetic customized TALEN construct Kiss1rL, transcription activator-like (TAL) effector DNA-binding domain
aacctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgac

SEQ ID NO: 12 - DNA, 1643 bp, Artificial Sequence
  synthetic customized TALEN construct Kiss1rR, transcription activator-like (TAL) effector DNA-binding domain
aacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 13 - DNA, 1745 bp, Artificial Sequence
  synthetic customized TALEN construct Kiss2rL, transcription activator-like (TAL) effector DNA-binding domain
aacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaagcattgtggcccagctgagccggcctgatccggcgttggccgcgttgac

SEQ ID NO: 14 - DNA, 1745 bp, Artificial Sequence
  synthetic customized TALEN construct Kiss2rR, transcription activator-like (TAL) effector DNA-binding domain
aacctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 15 - DNA, 1643 bp, Artificial Sequence
  synthetic customized TALEN construct Kiss1L, transcription activator-like (TAL) effector DNA-binding domain
aacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgac

SEQ ID NO: 16 - DNA, 1643 bp, Artificial Sequence
  synthetic customized TALEN construct Kiss1R, transcription activator-like (TAL) effector DNA-binding domain
aacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaagcattgtggcccagctgagccggcctgatccggcgttggccgcgttgac

SEQ ID NO: 17 - DNA, 1745 bp, Artificial Sequence
  synthetic customized TALEN construct Kiss2L, transcription activator-like (TAL) effector DNA-binding domain
aacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaagcattgtggcccagctgagccggcctgatccggcgttggccgcgttgac

SEQ ID NO: 18 - DNA, 1643 bp, Artificial Sequence
  synthetic customized TALEN construct Kiss2R, transcription activator-like (TAL) effector DNA-binding domain
aacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaagcattgtggcccagctgagccggcctgatccggcgttggccgcgttgac

SEQ ID NO: 19 - DNA, 1745 bp, Artificial Sequence
  synthetic customized TALEN construct GnRH3L, transcription activator-like (TAL) effector DNA-binding domain
aacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaagcattgtggcccagctgagccggcctgatccggcgttggccgcgttgac

SEQ ID NO: 20 - DNA, 1745 bp, Artificial Sequence
  synthetic customized TALEN construct GnRH3R, transcription activator-like (TAL) effector DNA-binding domain
aacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 21 - DNA, 1540 bp, Artificial Sequence
  synthetic customized TALEN construct SpexinL, transcription activator-like (TAL) effector DNA-binding domain
aacctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttga

SEQ ID NO: 22 - DNA, 1643 bp, Artificial Sequence
  synthetic customized TALEN construct SpexinR, transcription activator-like (TAL) effector DNA-binding domain
aacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgac

SEQ ID NO: 23 - DNA, 1643 bp, Artificial Sequence
  synthetic customized TALEN construct MiR-214L, transcription activator-like (TAL) effector DNA-binding domain
aacctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 24 - DNA, 1643 bp, Artificial Sequence
  synthetic customized TALEN construct Mir-214R, transcription activator-like (TAL) effector DNA-binding domain
aacctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaagcattgtggcccagctgagccggcctgatccggcgttggccgcgttgac

SEQ ID NO: 25 - DNA, 1643 bp, Artificial Sequence
  synthetic customized TALEN construct MiR-451L, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaagcattgtggcccagctgagccggcctgatccggcgttggccgcgttgac

SEQ ID NO: 26 - DNA, 1745 bp, Artificial Sequence
  synthetic customized TALEN construct MiR-451R, transcription activator-like (TAL) effector DNA-binding domain
aacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaagcattgtggcccagctgagccggcctgatccggcgttggccgcgttgac

SEQ ID NO: 27 - DNA, 1541 bp, Artificial Sequence
  synthetic customized TALEN construct MiR-1-1L, transcription activator-like (TAL) effector DNA-binding domain
aacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 28 - DNA, 1643 bp, Artificial Sequence
  synthetic customized TALEN construct Mir-1-1R, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 29 - DNA, 1745 bp, Artificial Sequence
  synthetic customized TALEN construct Mir-1-2L, transcription activator-like (TAL) effector DNA-binding domain
aacctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 30 - DNA, 1643 bp, Artificial Sequence
  synthetic customized TALEN construct MiR-1-2R, transcription activator-like (TAL) effector DNA-binding domain
aacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 31 - DNA, 1745 bp, Artificial Sequence
  synthetic customized TALEN construct MiR-17-92N1L, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 32 - DNA, 1643 bp, Artificial Sequence
  synthetic customized TALEN construct MiR-17-92N1R, transcription activator-like (TAL) effector DNA-binding domain
aacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 33 - DNA, 1847 bp, Artificial Sequence
  synthetic customized TALEN construct MiR-17-92N2L, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 34 - DNA, 1643 bp, Artificial Sequence
  synthetic customized TALEN construct MiR-17-N2R, transcription activator-like (TAL) effector DNA-binding domain
aacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaagcattgtggcccagctgagccggcctgatccggcgttggccgcgttgac

SEQ ID NO: 35 - DNA, 1847 bp, Artificial Sequence
  synthetic customized TALEN construct MiR-17-92C1L, transcription activator-like (TAL) effector DNA-binding domain
aacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaagcattgtggcccagctgagccggcctgatccggcgttggccgcgttgac

SEQ ID NO: 36 - DNA, 1847 bp, Artificial Sequence
  synthetic customized TALEN construct MiR-17-92C1R, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 37 - DNA, 1847 bp, Artificial Sequence
  synthetic customized TALEN construct MiR-17-92C2L, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 38 - DNA, 1847 bp, Artificial Sequence
  synthetic customized TALEN construct MiR-17-92C2R, transcription activator-like (TAL) effector DNA-binding domain
aacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 39 - DNA, 1745 bp, Artificial Sequence
  synthetic customized TALEN construct MiR-430N1L, transcription activator-like (TAL) effector DNA-binding domain
aacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 40 - DNA, 1745 bp, Artificial Sequence
  synthetic customized TALEN construct MiR-430N1R, transcription activator-like (TAL) effector DNA-binding domain
aacctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaagcattgtggcccagctgagccggcctgatccggcgttggccgcgttgac

SEQ ID NO: 41 - DNA, 1847 bp, Artificial Sequence
  synthetic customized TALEN construct MiR-430N2L, transcription activator-like (TAL) effector DNA-binding domain
aacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgac

SEQ ID NO: 42 - DNA, 1847 bp, Artificial Sequence
  synthetic customized TALEN construct MiR-430N2R, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 43 - DNA, 1847 bp, Artificial Sequence
  synthetic customized TALEN construct MiR-430C1L, transcription activator-like (TAL) effector DNA-binding domain
aacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaagcattgtggcccagctgagccggcctgatccggcgttggccgcgttgac

SEQ ID NO: 44 - DNA, 1745 bp, Artificial Sequence
  synthetic customized TALEN construct MiR-430C1R, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 45 - DNA, 1745 bp, Artificial Sequence
  synthetic customized TALEN construct MiR-430C2L, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 46 - DNA, 1847 bp, Artificial Sequence
  synthetic customized TALEN construct MiR-430C2R, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 47 - DNA, 1643 bp, Artificial Sequence
  synthetic customized TALEN construct Gria3aL1A, transcription activator-like (TAL) effector DNA-binding domain
aacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 48 - DNA, 1643 bp, Artificial Sequence
  synthetic customized TALEN construct Gria3aL1T, transcription activator-like (TAL) effector DNA-binding domain
aacctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 49 - DNA, 1643 bp, Artificial Sequence
  synthetic customized TALEN construct Gria3aL1G, transcription activator-like (TAL) effector DNA-binding domain
aacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 50 - DNA, 1643 bp, Artificial Sequence
  synthetic customized TALEN construct Gria3aL2A, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 51 - DNA, 1643 bp, Artificial Sequence
  synthetic customized TALEN construct Gria3aL2T, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 52 - DNA, 1643 bp, Artificial Sequence
  synthetic customized TALEN construct Gria3aL2C, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 53 - DNA, 1643 bp, Artificial Sequence
  synthetic customized TALEN construct Gria3aL7T, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 54 - DNA, 1643 bp, Artificial Sequence
  synthetic customized TALEN construct Gria3aL7C, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 55 - DNA, 1643 bp, Artificial Sequence
  synthetic customized TALEN construct Gria3aL7G, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 56 - DNA, 1643 bp, Artificial Sequence
  synthetic customized TALEN construct Gria3aL8A, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 57 - DNA, 1643 bp, Artificial Sequence
  synthetic customized TALEN construct Gria3aL8C, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 58 - DNA, 1643 bp, Artificial Sequence
  synthetic customized TALEN construct Gria3aL8G, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 59 - DNA, 1643 bp, Artificial Sequence
  synthetic customized TALEN construct Gria3aL15A, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 60 - DNA, 1643 bp, Artificial Sequence
  synthetic customized TALEN construct Gria3aL15C, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 61 - DNA, 1643 bp, Artificial Sequence
  synthetic customized TALEN construct Gria3aL15G, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 62 - DNA, 1643 bp, Artificial Sequence
  synthetic customized TALEN construct Gria3aL15.5A, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaagcattgtggcccagctgagccggcctgatccggcgttggccgcgttgac

SEQ ID NO: 63 - DNA, 1643 bp, Artificial Sequence
  synthetic customized TALEN construct Gria3aL15.5T, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgac

SEQ ID NO: 64 - DNA, 1643 bp, Artificial Sequence
  synthetic customized TALEN construct Gria3aL15.5G, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaagcattgtggcccagctgagccggcctgatccggcgttggccgcgttgac

SEQ ID NO: 65 - DNA, 1541 bp, Artificial Sequence
  synthetic customized TALEN construct Gria3aL-1C, transcription activator-like (TAL) effector DNA-binding domain
aacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 66 - DNA, 1541 bp, Artificial Sequence
  synthetic customized TALEN construct Gria3aL-2G, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 67 - DNA, 1541 bp, Artificial Sequence
  synthetic customized TALEN construct Gria3aL-7A, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 68 - DNA, 1541 bp, Artificial Sequence
  synthetic customized TALEN construct Gria3aL-8T, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 69 - DNA, 1541 bp, Artificial Sequence
  synthetic customized TALEN construct Gria3aL-15T, transcription activator-like (TAL) effector DNA-binding domain
aacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgac

SEQ ID NO: 70 - protein, 547 aa, Artificial Sequence
  synthetic customized TALEN construct Gria3aL, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 71 - protein, 546 aa, Artificial Sequence
  synthetic customized TALEN construct Gria3aR, transcription activator-like (TAL) effector DNA-binding domain
NLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASLTPDQVVAIASNNGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASLTPDQVVAIASHDGGKQALESIVAQLSRPDPALAAL

SEQ ID NO: 72 - protein, 513 aa, Artificial Sequence
  synthetic customized TALEN construct TnikbL, transcription activator-like (TAL) effector DNA-binding domain
NLTPDQVVAIASNNGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGGKQALESIVAQLSRPDPALAAL

SEQ ID NO: 73 - protein, 547 aa, Artificial Sequence
  synthetic customized TALEN construct TnikbR, transcription activator-like (TAL) effector DNA-binding domain
NLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALESIVAQLSRPDPALAAL

SEQ ID NO: 74 - protein, 547 aa, Artificial Sequence
  synthetic customized TALEN construct Kiss1rL, transcription activator-like (TAL) effector DNA-binding domain
NLTPDQVVAIASNGGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALESIVAQLSRPDPALAAL

SEQ ID NO: 75 - protein, 547 aa, Artificial Sequence
  synthetic customized TALEN construct Kiss1rR, transcription activator-like (TAL) effector DNA-binding domain
NLTPDQVVAIASNNGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASHDGGKQALESIVAQLSRPDPALAAL

SEQ ID NO: 76 - protein, 581 aa, Artificial Sequence
  synthetic customized TALEN construct Kiss2rL, transcription activator-like (TAL) effector DNA-binding domain
NLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNIGGKQALESIVAQLSRPDPALAAL

SEQ ID NO: 77 - protein, 581 aa, Artificial Sequence
  synthetic customized TALEN construct Kiss2rR, transcription activator-like (TAL) effector DNA-binding domain
NLTPDQVVAIASNGGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 78 - protein, 547 aa, Artificial Sequence
  synthetic customized TALEN construct Kiss1L, transcription activator-like (TAL) effector DNA-binding domain
NLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALESIVAQLSRPDPALAAL

SEQ ID NO: 79 - protein, 547 aa, Artificial Sequence
  synthetic customized TALEN construct Kiss1R, transcription activator-like (TAL) effector DNA-binding domain
NLTPDQVVAIASNNGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNNGGKQALESIVAQLSRPDPALAAL

SEQ ID NO: 80 - protein, 581 aa, Artificial Sequence
  synthetic customized TALEN construct Kiss2L, transcription activator-like (TAL) effector DNA-binding domain
NLTPDQVVAIASNNGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNNGGKQALESIVAQLSRPDPALAAL

SEQ ID NO: 81 - protein, 547 aa, Artificial Sequence
  synthetic customized TALEN construct Kiss2R, transcription activator-like (TAL) effector DNA-binding domain
NLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNNGGKQALESIVAQLSRPDPALAAL

SEQ ID NO: 82 - protein, 580 aa, Artificial Sequence
  synthetic customized TALEN construct GnRH3L, transcription activator-like (TAL) effector DNA-binding domain
LTPDQVVAIASNNGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNNGGKQALESIVAQLSRPDPALAAL

SEQ ID NO: 83 - protein, 581 aa, Artificial Sequence
  synthetic customized TALEN construct GnRH3R, transcription activator-like (TAL) effector DNA-binding domain
NLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASHDGGKQALESIVAQLSRPDPALAAL

SEQ ID NO: 84 - protein, 513 aa, Artificial Sequence
  synthetic customized TALEN construct SpexinL, transcription activator-like (TAL) effector DNA-binding domain
NLTPDQVVAIASNGGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGGKQALESIVAQLSRPDPALAAL

SEQ ID NO: 85 - protein, 547 aa, Artificial Sequence
  synthetic customized TALEN construct SpexinR, transcription activator-like (TAL) effector DNA-binding domain
NLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALESIVAQLSRPDPALAAL

SEQ ID NO: 86 - protein, 547 aa, Artificial Sequence
  synthetic customized TALEN construct MiR-214L, transcription activator-like (TAL) effector DNA-binding domain
NLTPDQVVAIASNNGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASHDGGKQALESIVAQLSRPDPALAAL

SEQ ID NO: 87 - protein, 547 aa, Artificial Sequence
  synthetic customized TALEN construct MiR-214R, transcription activator-like (TAL) effector DNA-binding domain
NLTPDQVVAIASNNGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNNGGKQALESIVAQLSRPDPALAAL

SEQ ID NO: 88 - protein, 547 aa, Artificial Sequence
  synthetic customized TALEN construct MiR-451L, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNIGGKQALESIVAQLSRPDPALAAL

SEQ ID NO: 89 - protein, 581 aa, Artificial Sequence
  synthetic customized TALEN construct MiR-451R, transcription activator-like (TAL) effector DNA-binding domain
NLTPDQVVAIASNIGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNNGGKQALESIVAQLSRPDPALAAL

SEQ ID NO: 90 - protein, 513 aa, Artificial Sequence
  synthetic customized TALEN construct MiR-1-1L, transcription activator-like (TAL) effector DNA-binding domain
NLTPDQVVAIASNIGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALESIVAQLSRPDPALAAL

SEQ ID NO: 91 - protein, 547 aa, Artificial Sequence
  synthetic customized TALEN construct MiR-1-1R, transcription activator-like (TAL) effector DNA-binding domain
NLTPDQVVAIASHDGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNNGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASHDGGKQALESIVAQLSRPDPALAAL

SEQ ID NO: 92 - protein, 581 aa, Artificial Sequence
  synthetic customized TALEN construct MiR-1-2L, transcription activator-like (TAL) effector DNA-binding domain
NLTPDQVVAIASNGGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALESIVAQLSRPDPALAAL

SEQ ID NO: 93 - protein, 547 aa, Artificial Sequence
  synthetic customized TALEN construct MiR-1-2R, transcription activator-like (TAL) effector DNA-binding domain
NLTPDQVVAIASNNGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASHDGGKQALESIVAQLSRPDPALAAL

SEQ ID NO: 94 - protein, 581 aa, Artificial Sequence
  synthetic customized TALEN construct MiR-17-92N1L, transcription activator-like (TAL) effector DNA-binding domain
NLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 95 - protein, 547 aa, Artificial Sequence
  synthetic customized TALEN construct MiR-17-92N1R, transcription activator-like (TAL) effector DNA-binding domain
NLTPDQVVAIASNIGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 96 - protein, 615 aa, Artificial Sequence
  synthetic customized TALEN construct MiR-17-92N2L, transcription activator-like (TAL) effector DNA-binding domain
NLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 97 - protein, 547 aa, Artificial Sequence
  synthetic customized TALEN construct MiR-17-92N2R, transcription activator-like (TAL) effector DNA-binding domain
NLTPDQVVAIASNIGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNNGGKQALESIVAQLSRPDPALAAL

SEQ ID NO: 98 - protein, 615 aa, Artificial Sequence
  synthetic customized TALEN construct MiR-17-92C1L, transcription activator-like (TAL) effector DNA-binding domain
NLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNIGGKQALESIVAQLSRPDPALAAL

SEQ ID NO: 99 - protein, 615 aa, Artificial Sequence
  synthetic customized TALEN construct MiR-17-92C1R, transcription activator-like (TAL) effector DNA-binding domain
NLTPDQVVAIASHDGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASHDGGKQALESIVAQLSRPDPALAAL

SEQ ID NO: 100 - protein, 615 aa, Artificial Sequence
  synthetic customized TALEN construct MiR-17-92C2L, transcription activator-like (TAL) effector DNA-binding domain
NLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 101 - protein, 615 aa, Artificial Sequence
  synthetic customized TALEN construct MiR-17-92C2R, transcription activator-like (TAL) effector DNA-binding domain
NLTPDQVVAIASNIGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNNGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 102 - protein, 581 aa, Artificial Sequence
  synthetic customized TALEN construct MiR-430N1L, transcription activator-like (TAL) effector DNA-binding domain
NLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 103 - protein, 581 aa, Artificial Sequence
  synthetic customized TALEN construct MiR-430N1R, transcription activator-like (TAL) effector DNA-binding domain
NLTPDQVVAIASNGGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALESIVAQLSRPDPALAAL

SEQ ID NO: 104 - protein, 615 aa, Artificial Sequence
  synthetic customized TALEN construct MiR-430N2L, transcription activator-like (TAL) effector DNA-binding domain
NLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALESIVAQLSRPDPALAAL

SEQ ID NO: 105 - protein, 615 aa, Artificial Sequence
  synthetic customized TALEN construct MiR-430N2R, transcription activator-like (TAL) effector DNA-binding domain
NLTPDQVVAIASHDGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 106 - protein, 615 aa, Artificial Sequence
  synthetic customized TALEN construct MiR-430C1L, transcription activator-like (TAL) effector DNA-binding domain
NLTPDQVVAIASNIGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNNGGKQALESIVAQLSRPDPALAAL

SEQ ID NO: 107 - protein, 581 aa, Artificial Sequence
  synthetic customized TALEN construct MiR-430C1R, transcription activator-like (TAL) effector DNA-binding domain
NLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALESIVAQLSRPDPALAAL

SEQ ID NO: 108 - protein, 581 aa, Artificial Sequence
  synthetic customized TALEN construct MiR-430C2L, transcription activator-like (TAL) effector DNA-binding domain
NLTPDQVVAIASHDGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASHDGGKQALESIVAQLSRPDPALAAL

SEQ ID NO: 109 - protein, 615 aa, Artificial Sequence
  synthetic customized TALEN construct MiR-430C2R, transcription activator-like (TAL) effector DNA-binding domain
NLTPDQVVAIASHDGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASHDGGKQALESIVAQLSRPDPALAAL

SEQ ID NO: 110 - protein, 547 aa, Artificial Sequence
  synthetic customized TALEN construct Gria3aL1A, transcription activator-like (TAL) effector DNA-binding domain
NLTPDQVVAIASNIGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 111 - protein, 547 aa, Artificial Sequence
  synthetic customized TALEN construct Gria3aL1T, transcription activator-like (TAL) effector DNA-binding domain
NLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 112 - protein, 547 aa, Artificial Sequence
  synthetic customized TALEN construct Gria3aL1G, transcription activator-like (TAL) effector DNA-binding domain
NLTPDQVVAIASNNGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 113 - protein, 547 aa, Artificial Sequence
  synthetic customized TALEN construct Gria3aL2A, transcription activator-like (TAL) effector DNA-binding domain
NLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 114 - protein, 547 aa, Artificial Sequence
  synthetic customized TALEN construct Gria3aL2T, transcription activator-like (TAL) effector DNA-binding domain
NLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 115 - protein, 547 aa, Artificial Sequence
  synthetic customized TALEN construct Gria3aL2C, transcription activator-like (TAL) effector DNA-binding domain
NLTPDQVVAIASHDGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 116 - protein, 547 aa, Artificial Sequence
  synthetic customized TALEN construct Gria3aL7T, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 117 - protein, 547 aa, Artificial Sequence
  synthetic customized TALEN construct Gria3aL7C, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 118 - protein, 547 aa, Artificial Sequence
  synthetic customized TALEN construct Gria3aL7G, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 119 - protein, 547 aa, Artificial Sequence
  synthetic customized TALEN construct Gria3aL8A, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 120 - protein, 547 aa, Artificial Sequence
  synthetic customized TALEN construct Gria3aL8C, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 121 - protein, 547 aa, Artificial Sequence
  synthetic customized TALEN construct Gria3aL8G, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 122 - protein, 547 aa, Artificial Sequence
  synthetic customized TALEN construct Gria3aL15A, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASHDGGKQALESIVAQLSRPDPALAAL

SEQ ID NO: 123 - protein, 547 aa, Artificial Sequence
  synthetic customized TALEN construct Gria3aL15C, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASHDGGKQALESIVAQLSRPDPALAAL

SEQ ID NO: 124 - protein, 547 aa, Artificial Sequence
  synthetic customized TALEN construct Gria3aL15G, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNNGGKQALETVQRLLPVLCQDHGLTPDQVVAIASHDGGKQALESIVAQLSRPDPALAAL

SEQ ID NO: 125 - protein, 547 aa, Artificial Sequence
  synthetic customized TALEN construct Gria3aL15.5A, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNIGGKQALESIVAQLSRPDPALAAL

SEQ ID NO: 126 - protein, 547 aa, Artificial Sequence
  synthetic customized TALEN construct Gria3aL15.5T, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALESIVAQLSRPDPALAAL

SEQ ID NO: 127 - protein, 547 aa, Artificial Sequence
  synthetic customized TALEN construct Gria3aL15.5G, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNNGGKQALESIVAQLSRPDPALAAL

SEQ ID NO: 128 - protein, 513 aa, Artificial Sequence
  synthetic customized TALEN construct Gria3aL-1C, transcription activator-like (TAL) effector DNA-binding domain
NLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 129 - protein, 513 aa, Artificial Sequence
  synthetic customized TALEN construct Gria3aL-2G, transcription activator-like (TAL) effector DNA-binding domain
NLTPDQVVAIASHDGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 130 - protein, 513 aa, Artificial Sequence
  synthetic customized TALEN construct Gria3aL-7A, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 131 - protein, 513 aa, Artificial Sequence
  synthetic customized TALEN construct Gria3aL-8T, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALESIVAQLSRPDPALAAL

SEQ ID NO: 132 - protein, 513 aa, Artificial Sequence
  synthetic customized TALEN construct Gria3aL-15T, transcription activator-like (TAL) effector DNA-binding domain
NLTPDQVVAIASHDGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALESIVAQLSRPDPALAAL

SEQ ID NO: 133 - DNA, 52 bp, Artificial Sequence
  synthetic wild-type (WT) zebrafish Gria3a TALEN binding region
agtcgtccaatagcttctcagtcacgcacgcctgtgagtttctgctctttat

SEQ ID NO: 134 - DNA, 52 bp, Artificial Sequence
  synthetic zebrafish Gria3a TALEN induced mutation
agtcgtccaatagcttctcagtctcagtcgcctgtgagtttctgctctttat

SEQ ID NO: 135 - DNA, 50 bp, Artificial Sequence
  synthetic zebrafish Gria3a TALEN induced mutation
agtcgtccaatagcttctcagtcacgcacctgtgagtttctgctctttat

SEQ ID NO: 136 - DNA, 50 bp, Artificial Sequence
  synthetic zebrafish Gria3a TALEN induced mutation
agtcgtccaatagcttctcaatagcttccctgtgagtttctgctctttat

SEQ ID NO: 137 - DNA, 49 bp, Artificial Sequence
  synthetic zebrafish Gria3a TALEN induced mutation
agtcgtccaatagcttctcagtcaccgcctgtgagtttctgctctttat

SEQ ID NO: 138 - DNA, 49 bp, Artificial Sequence
  synthetic zebrafish Gria3a TALEN induced mutation
agtcgtccaatagcttctcagtttttgcaggtgagtttctgctctttat

SEQ ID NO: 139 - DNA, 48 bp, Artificial Sequence
  synthetic zebrafish Gria3a TALEN induced mutation
agtcgtccaatagcttctcagtcacccctgggattttctgctctttat

SEQ ID NO: 140 - DNA, 48 bp, Artificial Sequence
  synthetic zebrafish Gria3a TALEN induced mutation
agtcgtccaatagcttctcagtcacgcctgtgagtttctgctctttat

SEQ ID NO: 141 - DNA, 48 bp, Artificial Sequence
  synthetic zebrafish Gria3a TALEN induced mutation
agtcgtccaatagcttctcagtcagtcctgtgagtttctgctctttat

SEQ ID NO: 142 - DNA, 48 bp, Artificial Sequence
  synthetic zebrafish Gria3a TALEN induced mutation
agtcgtccaatagcttctcagacatgattgtgagtttctgctctttat

SEQ ID NO: 143 - DNA, 47 bp, Artificial Sequence
  synthetic zebrafish Gria3a TALEN induced mutation
agtcgtccaatagcttctcactcagcctgtgagtttctgctctttat

SEQ ID NO: 144 - DNA, 46 bp, Artificial Sequence
  synthetic zebrafish Gria3a TALEN induced mutation
agtcgtccaatagcttctcagtcgcctgtgagtttctgctctttat

SEQ ID NO: 145 - DNA, 46 bp, Artificial Sequence
  synthetic zebrafish Gria3a TALEN induced mutation
agtcgtccaatagcttctcagtcacgtgtgagtttctgctctttat

SEQ ID NO: 146 - DNA, 46 bp, Artificial Sequence
  synthetic zebrafish Gria3a TALEN induced mutation
agtcgtccaatagcttctcagtcacctgtgagtttctgctctttat

SEQ ID NO: 147 - DNA, 45 bp, Artificial Sequence
  synthetic zebrafish Gria3a TALEN induced mutation
agtcgtccaatagcttctcagtcagttgaagtttctgctctttat

SEQ ID NO: 148 - DNA, 45 bp, Artificial Sequence
  synthetic zebrafish Gria3a TALEN induced mutation
agtcgtccaatagcttctcagtcactgtgagtttctgctctttat

SEQ ID NO: 149 - DNA, 44 bp, Artificial Sequence
  synthetic zebrafish Gria3a TALEN induced mutation
agtcgtccaatagcttctcagtcacgtgagtttctgctctttat

SEQ ID NO: 150 - DNA, 43 bp, Artificial Sequence
  synthetic zebrafish Gria3a TALEN induced mutation
agtcgcccaatagcttctcagtctgtgagtttctgctctttat

SEQ ID NO: 151 - DNA, 44 bp, Artificial Sequence
  synthetic zebrafish Gria3a TALEN induced mutation
agtcgtccaatagcttctcagtcctgtgagtttctgctctttat

SEQ ID NO: 152 - DNA, 43 bp, Artificial Sequence
  synthetic zebrafish Gria3a TALEN induced mutation
agtcgtccaatagcttctcagcctgtgagtttctgctctttat

SEQ ID NO: 153 - DNA, 43 bp, Artificial Sequence
  synthetic zebrafish Gria3a TALEN induced mutation
agtcgtccaatagcttctcagtctgtgagtttctgctctttat

SEQ ID NO: 154 - DNA, 42 bp, Artificial Sequence
  synthetic zebrafish Gria3a TALEN induced mutation
agtcgtccaatagcttctcgcctgtgagtttctgctctttat

SEQ ID NO: 155 - DNA, 41 bp, Artificial Sequence
  synthetic zebrafish Gria3a TALEN induced mutation
agtcgtccaatagcttctcagtgtgagtttctgctctttat

SEQ ID NO: 156 - DNA, 23 bp, Artificial Sequence
  synthetic zebrafish Gria3a TALEN induced mutation
agtcgtccaatagcttctcagtc

SEQ ID NO: 157 - DNA, 30 bp, Artificial Sequence
  synthetic zebrafish Gria3a TALEN induced mutation
cacgcacgcctgtgagtttctgctctttat

SEQ ID NO: 158 - DNA, 54 bp, Artificial Sequence
  synthetic zebrafish Gria3a TALEN induced mutation
agtcgtccaatagcttctcagtcagcttctcgcctgtgagtttctgctctttat

SEQ ID NO: 159 - DNA, 50 bp, Artificial Sequence
  synthetic wild-type (WT) zebrafish Tnikb TALEN binding region
ctgttattttctcccctaaggatcctgcgggcatttttgagctggtggag

SEQ ID NO: 160 - DNA, 50 bp, Artificial Sequence
  synthetic zebrafish Tnikb TALEN induced mutation
ctgttattttctcccctaaggcatctccgggcatttttgagctggtggag

SEQ ID NO: 161 - DNA, 44 bp, Artificial Sequence
  synthetic zebrafish Tnikb TALEN induced mutation
ctgttattttctcccctaaggcgggcatttttgagctggtggag

SEQ ID NO: 162 - DNA, 43 bp, Artificial Sequence
  synthetic zebrafish Tnikb TALEN induced mutation
ctgttattttctcccctaaggaggcatttttgagctggtggag

SEQ ID NO: 163 - DNA, 42 bp, Artificial Sequence
  synthetic zebrafish Tnikb TALEN induced mutation
ctgttattttctcccctaaggatcatttttgagctggtggag

SEQ ID NO: 164 - DNA, 42 bp, Artificial Sequence
  synthetic zebrafish Tnikb TALEN induced mutation
ctgttattttctcccctaaggagcatttttgagctggtggag

SEQ ID NO: 165 - DNA, 41 bp, Artificial Sequence
  synthetic zebrafish Tnikb TALEN induced mutation
ctgttattttctcccctgcgggcatttttgatctggtggag

SEQ ID NO: 166 - DNA, 41 bp, Artificial Sequence
  synthetic zebrafish Tnikb TALEN induced mutation
ctgttattttctcccctaagggcatttttgagctggtggag

SEQ ID NO: 167 - DNA, 40 bp, Artificial Sequence
  synthetic zebrafish Tnikb TALEN induced mutation
ctgttattttctcccctaaggcatttttgagctggtggag

SEQ ID NO: 168 - DNA, 39 bp, Artificial Sequence
  synthetic zebrafish Tnikb TALEN induced mutation
ctgttattttctcccctaaggatttttgagctggtggag

SEQ ID NO: 169 - DNA, 38 bp, Artificial Sequence
  synthetic zebrafish Tnikb TALEN induced mutation
ctgttattttctccccgggcatttttgagctggtggag

SEQ ID NO: 170 - DNA, 55 bp, Artificial Sequence
  synthetic zebrafish Tnikb TALEN induced mutation
ctgttattttctcccctaaggattttaaggagcgggcatttttgagctggtggag

SEQ ID NO: 171 - DNA, 58 bp, Artificial Sequence
  synthetic zebrafish Tnikb TALEN induced mutation
ctgttattttctcccctaaggaacattaccttttttgggcatttttgagctggtggag

SEQ ID NO: 172 - DNA, 52 bp, Artificial Sequence
  synthetic wild-type (WT) zebrafish Kiss1r TALEN binding region
cttcatgtgcaaatttgttgcttttcttcaacaggtaataatagaacctcag

SEQ ID NO: 173 - DNA, 50 bp, Artificial Sequence
  synthetic zebrafish Kiss1r TALEN induced mutation
cttcatgtgcaaatttgttgctttttcaacaggtaataatagaacctcag

SEQ ID NO: 174 - DNA, 49 bp, Artificial Sequence
  synthetic zebrafish Kiss1r TALEN induced mutation
cttcatgtgcaaatttgttgcttttcaacaggtaataatagaacctcag

SEQ ID NO: 175 - DNA, 47 bp, Artificial Sequence
  synthetic zebrafish Kiss1r TALEN induced mutation
cttcatgtgcaaatttgttgctttaacaggtaataatagaacctcag

SEQ ID NO: 176 - DNA, 47 bp, Artificial Sequence
  synthetic zebrafish Kiss1r TALEN induced mutation
cttcatgtgcaaatttgttgctgcaacaggtaataatagaacctcag

SEQ ID NO: 177 - DNA, 47 bp, Artificial Sequence
  synthetic zebrafish Kiss1r TALEN induced mutation
cttcatgtgcaaatttgttgcttcaacaggtaataatagaacctcag

SEQ ID NO: 178 - DNA, 46 bp, Artificial Sequence
  synthetic zebrafish Kiss1r TALEN induced mutation
cttcatgtgcaaatttgttgttcaacaggtaataatagaacctcag

SEQ ID NO: 179 - DNA, 46 bp, Artificial Sequence
  synthetic zebrafish Kiss1r TALEN induced mutation
cttcatgtgcaaatttgttgctcaacaggtaataatagaacctcag

SEQ ID NO: 180 - DNA, 45 bp, Artificial Sequence
  synthetic zebrafish Kiss1r TALEN induced mutation
cttcatgtgcaaatttgttgcttacaggtaataatagaacctcag

SEQ ID NO: 181 - DNA, 45 bp, Artificial Sequence
  synthetic zebrafish Kiss1r TALEN induced mutation
cttcatgtgcaaattttgttgcaacaggtaataatagaacctcag

SEQ ID NO: 182 - DNA, 44 bp, Artificial Sequence
  synthetic zebrafish Kiss1r TALEN induced mutation
cttcatgtgcaaatttgttgcaacaggtaataatagaacctcag

SEQ ID NO: 183 - DNA, 44 bp, Artificial Sequence; identical to SEQ ID NO: 182
  synthetic zebrafish Kiss1r TALEN induced mutation

SEQ ID NO: 184 - DNA, 42 bp, Artificial Sequence
  synthetic zebrafish Kiss1r TALEN induced mutation
cttcatgtgcaaatttgtcaacaggtaataatagaacctcag

SEQ ID NO: 185 - DNA, 41 bp, Artificial Sequence
  synthetic zebrafish Kiss1r TALEN induced mutation
cttcatgtgcaaatttgttacaggtaataatagaacctcag

SEQ ID NO: 186 - DNA, 53 bp, Artificial Sequence
  synthetic zebrafish Kiss1r TALEN induced mutation
cttcatgtgcaaatttgttgctttttcttcaacaggtaataatagaacctcag

SEQ ID NO: 187 - DNA, 57 bp, Artificial Sequence
  synthetic zebrafish Kiss1r TALEN induced mutation
cttcatgtgcaaatttgttgcaaatttgttgctcaacaggtaataatagaacctcag

SEQ ID NO: 188 - DNA, 57 bp, Artificial Sequence
  synthetic zebrafish Kiss1r TALEN induced mutation
cttcatgtgcaaatttgttgctttatttgtttgcaacaggtaataatagaacctcag

SEQ ID NO: 189 - DNA, 59 bp, Artificial Sequence
  synthetic zebrafish Kiss1r TALEN induced mutation
cttcatgtgcaaatttgttgcttttttatttgttgcaacaggtaataatagaacctcag

SEQ ID NO: 190 - DNA, 62 bp, Artificial Sequence
  synthetic zebrafish Kiss1r TALEN induced mutation
cttcatgtgcaaatttgttgcctttgttattaccttgtcaacaggtaataatagaacctcag

SEQ ID NO: 191 - DNA, 90 bp, Artificial Sequence
  synthetic zebrafish Kiss1r TALEN induced mutation
cttcatgtgcaaatttgttgctttaggtaatagttgcaaattagttgcaacaggtaataatagttgcaacaggtaataatagaacctcag

SEQ ID NO: 192 - DNA, 59 bp, Artificial Sequence
  synthetic wild-type (WT) zebrafish Kiss2r TALEN binding region
gtaacctaatagtcatctatgtggtcattaaaaaccagcagatgaagacggttacaaac

SEQ ID NO: 193 - DNA, 56 bp, Artificial Sequence
  synthetic zebrafish Kiss2r TALEN induced mutation
gtaacctaatagtcatctatgtggttaaaaaccagcagatgaagacggttacaaac

SEQ ID NO: 194 - DNA, 52 bp, Artificial Sequence
  synthetic zebrafish Kiss2r TALEN induced mutation
gtaacctaatagtcatcacattaaaaaccagcagatgaagacggttacaaac

SEQ ID NO: 195 - DNA, 62 bp, Artificial Sequence
  synthetic zebrafish Kiss2r TALEN induced mutation
gtaacctaatagtcatctatgtgtgtattattaaaaaccagcagatgaagacggttacaaac

SEQ ID NO: 196 - DNA, 53 bp, Artificial Sequence
  synthetic wild-type (WT) zebrafish Kiss1 TALEN binding region
gtacacacaaacccctctgggcattttcagtattacttagaaggtaagttcac

SEQ ID NO: 197 - DNA, 52 bp, Artificial Sequence
  synthetic zebrafish Kiss1 TALEN induced mutation
gtacacacaaacccctctgggcatttcagtattacttagaaggtaagttcac

SEQ ID NO: 198 - DNA, 52 bp, Artificial Sequence
  synthetic zebrafish Kiss1 TALEN induced mutation
gtacacacaaacccctctgggcattttagtattacttagaaggtaagttcac

SEQ ID NO: 199 - DNA, 52 bp, Artificial Sequence
  synthetic zebrafish Kiss1 TALEN induced mutation
gtacacacaaacccctctgggtacctaagtattacttagaaggtaagttcac

SEQ ID NO: 200 - DNA, 50 bp, Artificial Sequence
  synthetic zebrafish Kiss1 TALEN induced mutation
gtacacacaaacccctctgggcatcagtattacttagaaggtaagttcac

SEQ ID NO: 201 - DNA, 49 bp, Artificial Sequence
  synthetic zebrafish Kiss1 TALEN induced mutation
gtacacacaaacccctctgggcaaagtattacttagaaggtaagttcac

SEQ ID NO: 202 - DNA, 49 bp, Artificial Sequence
  synthetic zebrafish Kiss1 TALEN induced mutation
gtacacacaaacccctctgggtctggtattacttagaaggtaagttcac

SEQ ID NO: 203 - DNA, 49 bp, Artificial Sequence
  synthetic zebrafish Kiss1 TALEN induced mutation
gtacacacaaacccctctgggcattgtattacttagaaggtaagttcac

SEQ ID NO: 204 - DNA, 48 bp, Artificial Sequence
  synthetic zebrafish Kiss1 TALEN induced mutation
gtacacacaaacccctctgggcatgtattacttagaaggtaagttcac

SEQ ID NO: 205 - DNA, 46 bp, Artificial Sequence
  synthetic zebrafish Kiss1 TALEN induced mutation
gtacacacaaacccctctgggcatattacttagaaggtaagttcac

SEQ ID NO: 206 - DNA, 46 bp, Artificial Sequence
  synthetic zebrafish Kiss1 TALEN induced mutation
gtacacacaaacccctctgggcattttacttagaaggtaagttcac

SEQ ID NO: 207 - DNA, 45 bp, Artificial Sequence
  synthetic zebrafish Kiss1 TALEN induced mutation
gtacacacaaacccctctgggcattaccttagaaggtaagttcac

SEQ ID NO: 208 - DNA, 45 bp, Artificial Sequence
  synthetic zebrafish Kiss1 TALEN induced mutation
gtacacacaaacccctctaaagggttctttagaaggtaagttcac

SEQ ID NO: 209 - DNA, 44 bp, Artificial Sequence
  synthetic zebrafish Kiss1 TALEN induced mutation
gtacacacaaacccctctgggcattacttagaaggtaagttcac

SEQ ID NO: 210 - DNA, 41 bp, Artificial Sequence
  synthetic zebrafish Kiss1 TALEN induced mutation
gtacacacaaacccctctgggcacttagaaggtaagttcac

SEQ ID NO: 211 - DNA, 54 bp, Artificial Sequence
  synthetic zebrafish Kiss1 TALEN induced mutation
gtacacacaaacccctctgggcatttttcagtattacttagaaggtaagttcac

SEQ ID NO: 212 - DNA, 55 bp, Artificial Sequence
  synthetic zebrafish Kiss1 TALEN induced mutation
gtacacacaaacccctctgggcattactggggtattacttagaaggtaagttcac

SEQ ID NO: 213 - DNA, 59 bp, Artificial Sequence
  synthetic zebrafish Kiss1 TALEN induced mutation
gtacacacaaacccctctgggcattagtattctcagtattacttagaaggtaagttcac

SEQ ID NO: 214 - DNA, 61 bp, Artificial Sequence
  synthetic zebrafish Kiss1 TALEN induced mutation
gtacacacaaacccctctgggcattactatcctatgggtattacttagaaggtaagttcac

SEQ ID NO: 215 - DNA, 64 bp, Artificial Sequence
  synthetic zebrafish Kiss1 TALEN induced mutation
gtacacacaaacccctctgggcattaataccctcctctgggtattacttagaaggtaagttcac

SEQ ID NO: 216 - DNA, 55 bp, Artificial Sequence
  synthetic wild-type (WT) zebrafish Kiss2 TALEN binding region
ctgattctcttcatgtctgcaatggtcagtcagtctacagctatgagagcaatac

SEQ ID NO: 217 - DNA, 49 bp, Artificial Sequence
  synthetic zebrafish Kiss2 TALEN induced mutation
ctgattctcttcatgtctgcaatgcattctacagctatgaaagcaatac

SEQ ID NO: 218 - DNA, 48 bp, Artificial Sequence
  synthetic zebrafish Kiss2 TALEN induced mutation
ctgattctcttcatgtctgcaatcagtctacagctatgagagcaatac

SEQ ID NO: 219 - DNA, 48 bp, Artificial Sequence
  synthetic zebrafish Kiss2 TALEN induced mutation
ctgattctcttcatgtctgcaatggtcagacagctatgagagcaatac

SEQ ID NO: 220 - DNA, 47 bp, Artificial Sequence
  synthetic zebrafish Kiss2 TALEN induced mutation
ctgattctcttcatgtctgcaatggtctacagctatgagagcaatac

SEQ ID NO: 221 - DNA, 47 bp, Artificial Sequence
  synthetic zebrafish Kiss2 TALEN induced mutation
ctgattctcttcatgtctgcaatagtctacagctatgagagcaatac

SEQ ID NO: 222 - DNA, 47 bp, Artificial Sequence
  synthetic zebrafish Kiss2 TALEN induced mutation
ctgattctcttcatgtctgcaatggtcagcagctatgagagcaatac

SEQ ID NO: 223 - DNA, 47 bp, Artificial Sequence
  synthetic zebrafish Kiss2 TALEN induced mutation
ctgattctcttcatgtctgcagtggtctacagctatgagagcaatac

SEQ ID NO: 224 - DNA, 47 bp, Artificial Sequence
  synthetic zebrafish Kiss2 TALEN induced mutation
ctgattctcttcatgtctgcaacagtctacagctatgagagcaatac

SEQ ID NO: 225 - DNA, 46 bp, Artificial Sequence
  synthetic zebrafish Kiss2 TALEN induced mutation
ctgattctcttcatgtctgcaatgtctacagctatgagagcaatac

SEQ ID NO: 226 - DNA, 46 bp, Artificial Sequence
  synthetic zebrafish Kiss2 TALEN induced mutation
ctgattctcttcatgtctgcacagtctacagctatgagagcaatac

SEQ ID NO: 227 - DNA, 46 bp, Artificial Sequence; identical to SEQ ID NO: 225
  synthetic zebrafish Kiss2 TALEN induced mutation

SEQ ID NO: 228 - DNA, 46 bp, Artificial Sequence
  synthetic zebrafish Kiss2 TALEN induced mutation
ctgattctcttcatgtctgcaatggctacagctatgagagcaatac

SEQ ID NO: 229 - DNA, 44 bp, Artificial Sequence
  synthetic zebrafish Kiss2 TALEN induced mutation
ctgattctcttcatgtctgcagtctacagctatgagagcaatac

SEQ ID NO: 230 - DNA, 44 bp, Artificial Sequence
  synthetic zebrafish Kiss2 TALEN induced mutation
ctgattctcttcatgtctgcaatggtcagctatgagagcaatac

SEQ ID NO: 231 - DNA, 44 bp, Artificial Sequence; identical to SEQ ID NO: 229
  synthetic zebrafish Kiss2 TALEN induced mutation

SEQ ID NO: 232 - DNA, 37 bp, Artificial Sequence
  synthetic zebrafish Kiss2 TALEN induced mutation
ctgattctcttcatgtctacagctatgagagcaatac

SEQ ID NO: 233 - DNA, 35 bp, Artificial Sequence
  synthetic zebrafish Kiss2 TALEN induced mutation
ctgattctcttcatgtctgcaatggtctgcaatac

SEQ ID NO: 234 - DNA, 34 bp, Artificial Sequence
  synthetic zebrafish Kiss2 TALEN induced mutation
ctgattctcttcatgtctgctatgagagcaatac

SEQ ID NO: 235 - DNA, 26 bp, Artificial Sequence
  synthetic zebrafish Kiss2 TALEN induced mutation
ctgattctcagctatgagagcaatac

SEQ ID NO: 236 - DNA, 58 bp, Artificial Sequence
  synthetic zebrafish Kiss2 TALEN induced mutation
ctgattctcttcatgtctgcaatggtagtcagtcagtctacagctatgagagcaatac

SEQ ID NO: 237 - DNA, 65 bp, Artificial Sequence
  synthetic zebrafish Kiss2 TALEN induced mutation
ctgattctcttcatgtctgcaatggtcacttttgcattctacagctacagctatgagagcaatac

SEQ ID NO: 238 - DNA, 80 bp, Artificial Sequence
  synthetic zebrafish Kiss2 TALEN induced mutation
ctgattctcttcatgtctgcaatggtctacagaaaaaagtctacaaaagtctgcaaagtctacagctatgagagcaatac

SEQ ID NO: 239 - DNA, 82 bp, Artificial Sequence
  synthetic zebrafish Kiss2 TALEN induced mutation
ctgattctcttcatgtctgcaatggtatcagatcaaaatcagtcaatcaatcaaaatcagtctacagctatgagagcaatac

SEQ ID NO: 240 - DNA, 59 bp, Artificial Sequence
  synthetic wild-type (WT) zebrafish GnRH3 TALEN binding region
gtgttttagttttagcatggagtggaaaggaaggttgctggtccagttgttgctgttag

SEQ ID NO: 241 - DNA, 55 bp, Artificial Sequence
  synthetic zebrafish GnRH3 TALEN induced mutation
gtgttttagttttagcatggagtggaaaggttgctggtccagttgttgctgttag

SEQ ID NO: 242 - DNA, 43 bp, Artificial Sequence
  synthetic zebrafish GnRH3 TALEN induced mutation
gtgttttagttttagcatggagtggtccagttgttgctgttag

SEQ ID NO: 243 - DNA, 19 bp, Artificial Sequence
  synthetic zebrafish GnRH3 TALEN induced mutation
gtccagttgttgctgttag

SEQ ID NO: 244 - DNA, 60 bp, Artificial Sequence
  synthetic zebrafish GnRH3 TALEN induced mutation
gtgttttagttttagcatggagtggaaaggtccagctgttggtccagttgttgctgttag

SEQ ID NO: 245 - DNA, 60 bp, Artificial Sequence
  synthetic zebrafish GnRH3 TALEN induced mutation
gtgttttagttttagcatggagtggaaaggaaaggttgctggtccagttgttgctgttag

SEQ ID NO: 246 - DNA, 60 bp, Artificial Sequence
  synthetic zebrafish GnRH3 TALEN induced mutation
gtgttttagttttagcatggagtggaaaggaaggtttgttggtccagttgttgctgttag

SEQ ID NO: 247 - DNA, 51 bp, Artificial Sequence
  synthetic wild-type (WT) zebrafish Spexin TALEN binding region
atttgtgtcccattcctggagcgcacccaaggtaatgtcatgcaatgttat

SEQ ID NO: 248 - DNA, 48 bp, Artificial Sequence
  synthetic zebrafish Spexin TALEN induced mutation
atttgtgtcccattcctggagcgccaaggtaatgtcatgcaatgttat

SEQ ID NO: 249 - DNA, 47 bp, Artificial Sequence
  synthetic zebrafish Spexin TALEN induced mutation
atttgtgtcccattcctggagcgcaaggtaatgtcatgcaatgttat

SEQ ID NO: 250 - DNA, 47 bp, Artificial Sequence
  synthetic zebrafish Spexin TALEN induced mutation
atttgtgtcccattcctggagcggtaggtaatgtcatgcaatgttat

SEQ ID NO: 251 - DNA, 47 bp, Artificial Sequence
  synthetic zebrafish Spexin TALEN induced mutation
atttgtgtcccattcctggagcgccatgtaatgtcatgcaatgttat

SEQ ID NO: 252 - DNA, 47 bp, Artificial Sequence
  synthetic zebrafish Spexin TALEN induced mutation
atttgtgtcccattcccggagcgcaaggtaatgtcatgcaatgttat

SEQ ID NO: 253 - DNA, 46 bp, Artificial Sequence
  synthetic zebrafish Spexin TALEN induced mutation
atttgtgtcccattcctggagccaaggtaatgtcatgcaatgttat

SEQ ID NO: 254 - DNA, 46 bp, Artificial Sequence
  synthetic zebrafish Spexin TALEN induced mutation
atttgtgtcccattcctggagcgtaggtaatgtcatgcaatgttat

SEQ ID NO: 255 - DNA, 45 bp, Artificial Sequence
  synthetic zebrafish Spexin TALEN induced mutation
atttgtgtcccattcctggagcaaggtaatgtcatgcaatgttat

SEQ ID NO: 256 - DNA, 44 bp, Artificial Sequence
  synthetic zebrafish Spexin TALEN induced mutation
atttgtgtcccattcctggagcgaataatgtcatgcaatgttat

SEQ ID NO: 257 - DNA, 43 bp, Artificial Sequence
  synthetic zebrafish Spexin TALEN induced mutation
atttgtgtcccattcctggagcggtaatgtcatgcaatgttat

SEQ ID NO: 258 - DNA, 42 bp, Artificial Sequence
  synthetic zebrafish Spexin TALEN induced mutation
atttgtgtcccattcctggagcgtaatgtcatgcaatgttat

SEQ ID NO: 259 - DNA, 42 bp, Artificial Sequence; identical to SEQ ID NO: 258
  synthetic zebrafish Spexin TALEN induced mutation

SEQ ID NO: 260 - DNA, 41 bp, Artificial Sequence
  synthetic zebrafish Spexin TALEN induced mutation
atttgtgtcccattcctggaggtaatgtcatgcaatgttat

SEQ ID NO: 261 - DNA, 40 bp, Artificial Sequence
  synthetic zebrafish Spexin TALEN induced mutation
atttgtgtcccattcccaaggtaatgccttgcaatgttat

SEQ ID NO: 262 - DNA, 40 bp, Artificial Sequence
  synthetic zebrafish Spexin TALEN induced mutation
atttgtgtcccattcctggagtaatgtcatgcaatgttat

SEQ ID NO: 263 - DNA, 39 bp, Artificial Sequence
  synthetic zebrafish Spexin TALEN induced mutation
atttgtgtcccattccaaggtaatgtcatgcaatgttat

SEQ ID NO: 264 - DNA, 38 bp, Artificial Sequence
  synthetic zebrafish Spexin TALEN induced mutation
atttgtgtcccattcctggtaatgtcatgcaatgttat

SEQ ID NO: 265 - DNA, 37 bp, Artificial Sequence
  synthetic zebrafish Spexin TALEN induced mutation
atttgtgtcccattcctggagcgccatgcaatgttat

SEQ ID NO: 266 - DNA, 23 bp, Artificial Sequence
  synthetic zebrafish Spexin TALEN induced mutation
atttgtgtcccattcctggagcg

SEQ ID NO: 267 - DNA, 55 bp, Artificial Sequence
  synthetic zebrafish Spexin TALEN induced mutation
atttgtgtcccattcctggagcgcacccacccaaggtaatgtcatgcaatgttat

SEQ ID NO: 268 - DNA, 60 bp, Artificial Sequence
  synthetic zebrafish Spexin TALEN induced mutation
atttgtgtcccattccttgtgtcccattccatcacccaaggtaatgtcatgcaatgttat

SEQ ID NO: 269 - DNA, 54 bp, Artificial Sequence
  synthetic wild-type (WT) zebrafish mature MiR-214 TALEN binding region
gtgcagaacttcctgcacctgtacagcaggcacagacaggcagacagatggcag

SEQ ID NO: 270 - DNA, 47 bp, Artificial Sequence
  synthetic zebrafish MiR-214 TALEN induced mutation
gtgcagaacttcctgcacctgtacacagacaggcagacagatggcag

SEQ ID NO: 271 - DNA, 45 bp, Artificial Sequence
  synthetic zebrafish MiR-214 TALEN induced mutation
gtgcagaacttcctgcacctgtacagacaggcagacagatggcag

SEQ ID NO: 272 - DNA, 45 bp, Artificial Sequence
  synthetic zebrafish MiR-214 TALEN induced mutation
gtgcagaacttcctgcgcctgcacagacaggcagacagatggcag

SEQ ID NO: 273 - DNA, 45 bp, Artificial Sequence
  synthetic zebrafish MiR-214 TALEN induced mutation
gtgcagaacttcctgcacctgtacagaccggcagacagatggcag

SEQ ID NO: 274 - DNA, 44 bp, Artificial Sequence
  synthetic zebrafish MiR-214 TALEN induced mutation
gtgcagaacttcctgcacctgtacagattgcagacagatggcag

SEQ ID NO: 275 - DNA, 41 bp, Artificial Sequence
  synthetic zebrafish MiR-214 TALEN induced mutation
gtgcagaacttcctgcacctgtacaggcagacagatggcag

SEQ ID NO: 276 - DNA, 40 bp, Artificial Sequence
  synthetic zebrafish MiR-214 TALEN induced mutation
gtgcagaacttccaggcacagacaggcagacagatggcag

SEQ ID NO: 277 - DNA, 37 bp, Artificial Sequence
  synthetic zebrafish MiR-214 TALEN induced mutation
gtgcagaacttcctgcacctgtacagacagatggcag

SEQ ID NO: 278 - DNA, 37 bp, Artificial Sequence
  synthetic zebrafish MiR-214 TALEN induced mutation
gtgcagaacttcctgcaccttcctgcacagatggcag

SEQ ID NO: 279 - DNA, 37 bp, Artificial Sequence; identical to SEQ ID NO: 277
  synthetic zebrafish MiR-214 TALEN induced mutation

SEQ ID NO: 280 - DNA, 33 bp, Artificial Sequence
  synthetic zebrafish MiR-214 TALEN induced mutation
gtgcagaacttcctgcacctgtacagatggcag

SEQ ID NO: 281 - DNA, 32 bp, Artificial Sequence
  synthetic zebrafish MiR-214 TALEN induced mutation
gtgcagaacttcctgcacctgtcagatggcag

SEQ ID NO: 282 - RNA, 100 nt, Artificial Sequence
  synthetic wild type pre-MiR-214 hairpin structure
ugacugagagcguugucugucugccugucuacacuugcugugcagaacuuccugcaccuguacagcaggcacagacaggcagacagauggcagcccgccu

SEQ ID NO: 283 - RNA, 91 nt, Artificial Sequence
  synthetic pre-MiR-214 mutant hairpin structure
ugacugagagcguugucugucugccugucuacacuugcugugcagaacuuccugcaccuguacagacaggcagacagauggcagcccgccu

SEQ ID NO: 284 - DNA, 59 bp, Artificial Sequence
  synthetic wild-type (WT) zebrafish MiR-451 TALEN binding region
atcgctgtgacagagagaggcggcgaaaccgttaccattactgagtttagtaatggtaa

SEQ ID NO: 285 - DNA, 39 bp, Artificial Sequence
  synthetic zebrafish MiR-451 TALEN induced mutation
atcgctgtgacagagagaggctgagtttagtaatggtaa

SEQ ID NO: 286 - DNA, 38 bp, Artificial Sequence
  synthetic zebrafish MiR-451 TALEN induced mutation
atcgctgtgacagagagaggcgagtttagtaatggtaa

SEQ ID NO: 287 - RNA, 60 nt, Artificial Sequence
  synthetic wild type pre-MiR-451 hairpin structure
uuuccgucgucuugggaaugguaaugauuugagucauuaccauugccaaagcggcggaga

SEQ ID NO: 288 - RNA, 39 nt, Artificial Sequence
  synthetic pre-MiR-451 mutant hairpin structure
uuuccgucgucuugggaaugguaaugauuugagcggaga

SEQ ID NO: 289 - DNA, 51 bp, Artificial Sequence
  synthetic wild-type (WT) zebrafish MiR-1-1 TALEN binding region
atatgaacaagagcagctatggaatgtaaagaagtatgtatcccaggtgag

SEQ ID NO: 290 - DNA, 50 bp, Artificial Sequence
  synthetic zebrafish MiR-1-1 TALEN induced mutation
atatgaacaagagcagctatggaatgtaagaagtatgtatcccaggtgag

SEQ ID NO: 291 - DNA, 47 bp, Artificial Sequence
  synthetic zebrafish MiR-1-1 TALEN induced mutation
atatgaacaagagcagctatgctaaagaagtatgtatcccaggtgag

SEQ ID NO: 292 - DNA, 47 bp, Artificial Sequence
  synthetic zebrafish MiR-1-1 TALEN induced mutation
atatgaacaagagcagctatggaaaagaagtatgtatcccaggtgag

SEQ ID NO: 293 - DNA, 46 bp, Artificial Sequence
  synthetic zebrafish MiR-1-1 TALEN induced mutation
atatgaacaagagcagctatggaagaagatatgtatcccaggtgag

SEQ ID NO: 294 - DNA, 45 bp, Artificial Sequence
  synthetic zebrafish MiR-1-1 TALEN induced mutation
atatgaacaagagcagctatggaagaagtatgtatcccaggtgag

SEQ ID NO: 295 - DNA, 45 bp, Artificial Sequence
  synthetic zebrafish MiR-1-1 TALEN induced mutation
atatgaacaagagcagctatgaaagaagtatgtatcccaggtgag

SEQ ID NO: 296 - DNA, 45 bp, Artificial Sequence
  synthetic zebrafish MiR-1-1 TALEN induced mutation
atatgaacaagagcagctatggatgaagtatgtatcccaggtgag

SEQ ID NO: 297 - DNA, 45 bp, Artificial Sequence
  synthetic zebrafish MiR-1-1 TALEN induced mutation
atatgaacaagagcagctatggaagaagtatgaatcccaggtgag

SEQ ID NO: 298 - DNA, 44 bp, Artificial Sequence
  synthetic zebrafish MiR-1-1 TALEN induced mutation
atatgaacaagagcagctataaagaagtatgtatcccaggtgag

SEQ ID NO: 299 - DNA, 44 bp, Artificial Sequence
  synthetic zebrafish MiR-1-1 TALEN induced mutation
atatgaacaagagcagctatggagaagtatgtatcccaggtgag

SEQ ID NO: 300 - DNA, 44 bp, Artificial Sequence
  synthetic zebrafish MiR-1-1 TALEN induced mutation
atatgaacaagagcagctatgaagaagtatgtatcccaggtgag

SEQ ID NO: 301 - DNA, 43 bp, Artificial Sequence
  synthetic zebrafish MiR-1-1 TALEN induced mutation
atatgaacaagagcagctataagaagtatgtatcccaggtgag

SEQ ID NO: 302 - DNA, 42 bp, Artificial Sequence
  synthetic zebrafish MiR-1-1 TALEN induced mutation
atatgaacaagagcagctatagaagtatgtatcccaggtgag

SEQ ID NO: 303 - DNA, 43 bp, Artificial Sequence
  synthetic zebrafish MiR-1-1 TALEN induced mutation
atatgaacaagagcagctatggagagtatgtatcccaggtgag

SEQ ID NO: 304 - DNA, 42 bp, Artificial Sequence
  synthetic zebrafish MiR-1-1 TALEN induced mutation
atatgaacaagagcagctatggaagtatgtatcccaggtgag

SEQ ID NO: 305 - DNA, 41 bp, Artificial Sequence
  synthetic zebrafish MiR-1-1 TALEN induced mutation
atatgaacaagagcagctatggagtatgtatcccaggtgag

SEQ ID NO: 306 - DNA, 41 bp, Artificial Sequence
  synthetic zebrafish MiR-1-1 TALEN induced mutation
atatgaacaagagcagcaaagaagtatgtatcccaggtgag

SEQ ID NO: 307 - DNA, 41 bp, Artificial Sequence
  synthetic zebrafish MiR-1-1 TALEN induced mutation
atatgaacaagagcagtaaagaagtatgtatcccaggtgag

SEQ ID NO: 308 - DNA, 34 bp, Artificial Sequence
  synthetic zebrafish MiR-1-1 TALEN induced mutation
atatgaacaagagcagctatgtatcccaggtgag

SEQ ID NO: 309 - DNA, 31 bp, Artificial Sequence
  synthetic zebrafish MiR-1-1 TALEN induced mutation
atatgaacaagaactatgtttcccaggtgag

SEQ ID NO: 310 - DNA, 30 bp, Artificial Sequence
  synthetic zebrafish MiR-1-1 TALEN induced mutation
atatgtaaagaagtatgtatcccaggtgag

SEQ ID NO: 311 - DNA, 24 bp, Artificial Sequence
  synthetic zebrafish MiR-1-1 TALEN induced mutation
atatgaacaagagcagctatggaa

SEQ ID NO: 312 - DNA, 21 bp, Artificial Sequence
  synthetic zebrafish MiR-1-1 TALEN induced mutation
gaagtatgtatcccaggtgag

SEQ ID NO: 313 - DNA, 53 bp, Artificial Sequence
  synthetic zebrafish MiR-1-1 TALEN induced mutation
atatgaacaagagcagctatggaagtatgtaagaagtatgtatcccaggtgag

SEQ ID NO: 314 - DNA, 57 bp, Artificial Sequence
  synthetic zebrafish MiR-1-1 TALEN induced mutation
atatgaacaagagcagctatgagaagtagaacctaagaagtatgtatcccaggtgag

SEQ ID NO: 315 - DNA, 60 bp, Artificial Sequence
  synthetic zebrafish MiR-1-1 TALEN induced mutation
atatgaacaagagcagctatggaaagtatgaaaagtaaagaagtatgtatcccaggtgag

SEQ ID NO: 316 - DNA, 62 bp, Artificial Sequence
  synthetic zebrafish MiR-1-1 TALEN induced mutation
atatgaacaagagcagctatggaagtatgtatcccaggtgagaagtatgtatcccaggtgag

SEQ ID NO: 317 - DNA, 72 bp, Artificial Sequence
  synthetic zebrafish MiR-1-1 TALEN induced mutation
atatgaacaagagcagctatggatgtatgtagtatgtattgtatggatgtagaagtatgtatcccaggtgag

SEQ ID NO: 318 - DNA, 72 bp, Artificial Sequence
  synthetic zebrafish MiR-1-1 TALEN induced mutation
atatgaacaagagcagctagtatgaagtatgtataattggagcagctagtagaagtatgtatcccaggtgag

SEQ ID NO: 319 - RNA, 106 nt, Artificial Sequence
  synthetic wild type pre-MiR-1-1 hairpin structure
gcccauauaucccgcuugguagacauacuucuuuauaugcccauaugaacaagagcagcuauggaauguaaagaaguauguaucccaggugagagaaaaacggggc

SEQ ID NO: 320 - RNA, 100 nt, Artificial Sequence
  synthetic pre-MiR-1-1 mutant hairpin structure
gcccauauaucccgcuugguagacauacuucuucuuuauaugcccauaugaacaagagcagcuauggaaguauguaucccaggugagagaaaaacggggc

SEQ ID NO: 321 - DNA, 52 bp, Artificial Sequence
  synthetic wild-type (WT) zebrafish MiR-1-2 TALEN binding region
atatgaacatataaaagctatggaatgtaaagaagtatgtattcttggtcag

SEQ ID NO: 322 - DNA, 51 bp, Artificial Sequence
  synthetic zebrafish MiR-1-2 TALEN induced mutation
atatgaacatataaaagctatggaatgtaagaagtatgtattcttggtcag

SEQ ID NO: 323 - DNA, 50 bp, Artificial Sequence
  synthetic zebrafish MiR-1-2 TALEN induced mutation
atatgaacatataaaagctatggagtaaagaagtatgtattcttggtcag

SEQ ID NO: 324 - DNA, 48 bp, Artificial Sequence
  synthetic zebrafish MiR-1-2 TALEN induced mutation
atatgaacatataaaagctatggaagagaagtatgtattcttggtcag

SEQ ID NO: 325 - DNA, 47 bp, Artificial Sequence
  synthetic zebrafish MiR-1-2 TALEN induced mutation
atatgaacatataaaagctatggaatgaagtatgtattcttggtcag

SEQ ID NO: 326 - DNA, 47 bp, Artificial Sequence
  synthetic zebrafish MiR-1-2 TALEN induced mutation
atatgaacatataaaagctatggaaagaagtatgtattcttggtcag

SEQ ID NO: 327 - DNA, 47 bp, Artificial Sequence; identical to SEQ ID NO: 326
  synthetic zebrafish MiR-1-2 TALEN induced mutation

SEQ ID NO: 328 - DNA, 47 bp, Artificial Sequence
  synthetic zebrafish MiR-1-2 TALEN induced mutation
atatgaacatataaaagctatgaaaggaagtatgtattcttggtcag

SEQ ID NO: 329 - DNA, 46 bp, Artificial Sequence
  synthetic zebrafish MiR-1-2 TALEN induced mutation
atatgaacatataaaagctatggaagaagtatgtattcttggtcag

SEQ ID NO: 330 - DNA, 44 bp, Artificial Sequence
  synthetic zebrafish MiR-1-2 TALEN induced mutation
atatgaacatataaaagctatggaatgtatgtattcttggtcag

SEQ ID NO: 331 - DNA, 43 bp, Artificial Sequence
  synthetic zebrafish MiR-1-2 TALEN induced mutation
atatgaacatataaaagctatggaagtatgtattcttggtcag

SEQ ID NO: 332 - DNA, 43 bp, Artificial Sequence
  synthetic zebrafish MiR-1-2 TALEN induced mutation
atatgaacatataaaagctatggaagtttgtattcttggtcag

SEQ ID NO: 333 - DNA, 43 bp, Artificial Sequence; identical to SEQ ID NO: 331
  synthetic zebrafish MiR-1-2 TALEN induced mutation

SEQ ID NO: 334 - DNA, 35 bp, Artificial Sequence
  synthetic zebrafish MiR-1-2 TALEN induced mutation
atatgaacatataaaagctatgtattcttggtcag

SEQ ID NO: 335 - DNA, 33 bp, Artificial Sequence
  synthetic zebrafish MiR-1-2 TALEN induced mutation
atatgaacatataaagtatgtattcttggtcag

SEQ ID NO: 336 - DNA, 61 bp, Artificial Sequence
  synthetic zebrafish MiR-1-2 TALEN induced mutation
atatgaacatataaaagctatggaagccgttgttaaagaagaagtatgtattcttggtcag

SEQ ID NO: 337 - DNA, 63 bp, Artificial Sequence
  synthetic zebrafish MiR-1-2 TALEN induced mutation
atatgaacatataaaagctatggagcatatggaacatataaagaagtatgtattcttggtcag

SEQ ID NO: 338 - DNA, 63 bp, Artificial Sequence; identical to SEQ ID NO: 337
  synthetic zebrafish MiR-1-2 TALEN induced mutation

SEQ ID NO: 339 - DNA, 69 bp, Artificial Sequence
  synthetic zebrafish MiR-1-2 TALEN induced mutation
atatgaacatataaaagctatggaagtatccagcttctggaatgtaaagaagtatgtattcttggtcag

SEQ ID NO: 340 - DNA, 70 bp, Artificial Sequence
  synthetic zebrafish MiR-1-2 TALEN induced mutation
atatgaacatataaaagctatggaatgtatgtattcttggaaatggaaagaagtatgtattcttggtcag

SEQ ID NO: 341 - DNA, 99 bp, Artificial Sequence
  synthetic zebrafish MiR-1-2 TALEN induced mutation
atatgaacatataaaagctatggaatagaagtatgtatgtatgtatgtatgtatgtatgtatgtatgtatgtatgtaagaagtatgtattcttggtcag

SEQ ID NO: 342 - RNA, 87 nt, Artificial Sequence
  synthetic wild type pre-MiR-1-2 hairpin structure
uggacugguucuuauguaugaagaaauguaagguaucgaaaauauacaaguauacccguguauuucuucauacaugugguucauccg

SEQ ID NO: 343 - RNA, 81 nt, Artificial Sequence
  synthetic pre-MiR-1-2 mutant hairpin structure
uggacugguucuuauguaugaagaagguaucgaaaauauacaaguauacccguguauuucuucauacaugugguucauccg

SEQ ID NO: 344 - DNA, 53 bp, Artificial Sequence
  synthetic wild-type (WT) zebrafish MiR-17-92N1 TALEN binding region
gtcaaccccatgtaccatcaatatctattgtatttgaataattctacaggtaa

SEQ ID NO: 345 - DNA, 48 bp, Artificial Sequence
  synthetic zebrafish MiR-17-92N1 TALEN induced mutation
gtcaaccccatgtaccatcaatatgtatttgaataattctacaggtaa

SEQ ID NO: 346 - DNA, 44 bp, Artificial Sequence
  synthetic zebrafish MiR-17-92N1 TALEN induced mutation
gtcaaccccatgtaccatcaatatttgaataattctacaggtaa

SEQ ID NO: 347 - DNA, 66 bp, Artificial Sequence
  synthetic zebrafish MiR-17-92N1 TALEN induced mutation
gtcaaccccatgtaccatcaatatctcaattgtattcaaattgtatttgaataattctacaggtaa

SEQ ID NO: 348 - DNA, 54 bp, Artificial Sequence
  synthetic wild-type (WT) zebrafish MiR-17-92N2 TALEN binding region
ctcaaatatttctccccttccccctctcagaattcccaggaaagatgggagtag

SEQ ID NO: 349 - DNA, 48 bp, Artificial Sequence
  synthetic zebrafish MiR-17-92N2 TALEN induced mutation
ctcaaatatttctccccttccccctcttcccaggaaagatgggagtag

SEQ ID NO: 350 - DNA, 47 bp, Artificial Sequence
  synthetic zebrafish MiR-17-92N2 TALEN induced mutation
ctcaaatatttctccccttcccccattcccaggaaagatgggagtag

SEQ ID NO: 351 - DNA, 39 bp, Artificial Sequence
  synthetic zebrafish MiR-17-92N2 TALEN induced mutation
ctcaaatatttctccccttcccaggaaagatgggagtag

SEQ ID NO: 352 - DNA, 56 bp, Artificial Sequence
  synthetic wild-type (WT) zebrafish MiR-17-92C1 TALEN binding region
ttattatcttaacactgtaatttttacaccatgcaaggcatgattaacatttagac

SEQ ID NO: 353 - DNA, 55 bp, Artificial Sequence
  synthetic zebrafish MiR-17-92C1 TALEN induced mutation
ttattatcttaacactgtaatttttacacatgcaaggcatgattaacatttagac

SEQ ID NO: 354 - DNA, 52 bp, Artificial Sequence
  synthetic zebrafish MiR-17-92C1 TALEN induced mutation
ttattatcttaacactgtaatttttcatgcaaggcatgattaacatttagac

SEQ ID NO: 355 - DNA, 52 bp, Artificial Sequence
  synthetic zebrafish MiR-17-92C1 TALEN induced mutation
ttattgtcttaacactgtaattgcaaatgcaaggcatgattaacatttagac

SEQ ID NO: 356 - DNA, 49 bp, Artificial Sequence
  synthetic zebrafish MiR-17-92C1 TALEN induced mutation
ttattatcttaacactgtaatttttgcaaggcatgattaacatttagac

SEQ ID NO: 357 - DNA, 49 bp, Artificial Sequence
  synthetic zebrafish MiR-17-92C1 TALEN induced mutation
ttattatcttaacactgtaatttttacaaggcatgattaacatttagac

SEQ ID NO: 358 - DNA, 45 bp, Artificial Sequence
  synthetic zebrafish MiR-17-92C1 TALEN induced mutation
ttattatcttaacactgtaattcaaggcatgattaacatttagac

SEQ ID NO: 359 - DNA, 32 bp, Artificial Sequence
  synthetic zebrafish MiR-17-92C1 TALEN induced mutation
ttattatcttagggcatgattaacatttagac

SEQ ID NO: 360 - DNA, 62 bp, Artificial Sequence
  synthetic zebrafish MiR-17-92C1 TALEN induced mutation
ttattatcttaacactgtaatttttacaaattatgaatgcaaggcatgattaacatttagac

SEQ ID NO: 361 - DNA, 65 bp, Artificial Sequence
  synthetic zebrafish MiR-17-92C1 TALEN induced mutation
ttattatcttaacactgtaattttttctaaatgttaatcatgcaaggcatgattaacatttagac

SEQ ID NO: 362 - DNA, 73 bp, Artificial Sequence
  synthetic zebrafish MiR-17-92C1 TALEN induced mutation
ttattatcttaacactgtaatttttacaaggcaaggcatgcaaggcattgcaaggcatgattaacatttagac

SEQ ID NO: 363 - DNA, 56 bp, Artificial Sequence
  synthetic wild-type (WT) zebrafish MiR-17-92C2 TALEN binding region
ctcttcagatttatcaaatccaattataaaaatgcagagtaagccgagtaatctag

SEQ ID NO: 364 - DNA, 55 bp, Artificial Sequence
  synthetic zebrafish MiR-17-92C2 TALEN induced mutation
ctcttcagatttatcaaatccaattataaaatgcagagtaagccgagtaatctag

SEQ ID NO: 365 - DNA, 55 bp, Artificial Sequence
  synthetic zebrafish MiR-17-92C2 TALEN induced mutation
ctcttcagatttatcaaatccaatccaaaaatgcagagtaagccgagtaatctag

SEQ ID NO: 366 - DNA, 50 bp, Artificial Sequence
  synthetic zebrafish MiR-17-92C2 TALEN induced mutation
ctcttcagatttatcaaatccaattatgcagagtaagccgagtaatctag

SEQ ID NO: 367 - DNA, 39 bp, Artificial Sequence
  synthetic wild-type (WT) zebrafish MiR-17-92N1C1 TALEN binding region
tcaaccccatgtaccatcaatatgcctgattaacattta

SEQ ID NO: 368 - DNA, 42 bp, Artificial Sequence
  synthetic zebrafish MiR-17-92N1C1 TALEN induced mutation
tcaaccccatgtaccatcaatgcaaggcatgattaacattta

SEQ ID NO: 369 - DNA, 43 bp, Artificial Sequence
  synthetic zebrafish MiR-17-92N1C1 TALEN induced mutation
tcaaccccatgtaccatcaatatcaaggcatgattaacattta

SEQ ID NO: 370 - DNA, 44 bp, Artificial Sequence
  synthetic zebrafish MiR-17-92N1C1 TALEN induced mutation
tcaaccccatgtaccatcaatatgcaaggcatgattaacattta

SEQ ID NO: 371 - DNA, 46 bp, Artificial Sequence
  synthetic zebrafish MiR-17-92N1C1 TALEN induced mutation
tcaaccccatgtaccatcaatatctgcaaggcatgattaacattta

SEQ ID NO: 372 - DNA, 46 bp, Artificial Sequence
  synthetic zebrafish MiR-17-92N1C1 TALEN induced mutation
tcaaccccatgtaccatcaatacaagcaaggcatgattaacattta

SEQ ID NO: 373 - DNA, 51 bp, Artificial Sequence
  synthetic zebrafish MiR-17-92N1C1 TALEN induced mutation
tcaaccccatgtaccatcaatatatcatatgcaaggcatgattaacattta

SEQ ID NO: 374 - DNA, 58 bp, Artificial Sequence
  synthetic zebrafish MiR-17-92N1C1 TALEN induced mutation
tcaaccccatgtaccatcaatatgggatgattaaccatcaaggcatgattaacattta

SEQ ID NO: 375 - DNA, 72 bp, Artificial Sequence
  synthetic zebrafish MiR-17-92N1C1 TALEN induced mutation
tcaaccccatgtaccccatgtaccatcaatatgcatgtaccatcaatatgcaaggcatgattaacatttaga

SEQ ID NO: 376 - DNA, 33 bp, Artificial Sequence
  synthetic wild-type (WT) zebrafish MiR-17-92N2C1 TALEN binding region
tcaaatatttctcccctgcatgatcaacattta

SEQ ID NO: 377 - DNA, 38 bp, Artificial Sequence
  synthetic zebrafish MiR-17-92N2C1 TALEN induced mutation
tcaaatatttctccccttccccctctgattaacattta

SEQ ID NO: 378 - DNA, 39 bp, Artificial Sequence
  synthetic zebrafish MiR-17-92N2C1 TALEN induced mutation
tcaaatatttctccccatgcaaggcatgattaacattta

SEQ ID NO: 379 - DNA, 41 bp, Artificial Sequence
  synthetic zebrafish MiR-17-92N2C1 TALEN induced mutation
tcaaatatttctccccttccccaaggcatgattaacattta

SEQ ID NO: 380 - DNA, 42 bp, Artificial Sequence
  synthetic zebrafish MiR-17-92N2C1 TALEN induced mutation
tcaaatatttctccccttccccaaaggcatgattaacattta

SEQ ID NO: 381 - DNA, 45 bp, Artificial Sequence
  synthetic zebrafish MiR-17-92N2C1 TALEN induced mutation
tcaaatatttctccccttccccctgcaaggcatgattaacattta

SEQ ID NO: 382 - DNA, 48 bp, Artificial Sequence
  synthetic zebrafish MiR-17-92N2C1 TALEN induced mutation
tcaaatatttctccccttccccctcatgcaaggcatgattaacattta

SEQ ID NO: 383 - DNA, 60 bp, Artificial Sequence
  synthetic zebrafish MiR-17-92N2C1 TALEN induced mutation
tcaaatatttctccccttccccctttttcattaacatttacaaggcatgattaacattta

SEQ ID NO: 384 - DNA, 44 bp, Artificial Sequence
  synthetic wild-type (WT) zebrafish MiR-17-92N1C2 TALEN binding region
tcaaccccatgtaccatcaatatcagagtaagccgagtaatcta

SEQ ID NO: 385 - DNA, 46 bp, Artificial Sequence
  synthetic zebrafish MiR-17-92N1C2 TALEN induced mutation
tcaaccccatgtaccatcaataatgcagagtaagccgagtaatcta

SEQ ID NO: 386 - DNA, 48 bp, Artificial Sequence
  synthetic zebrafish MiR-17-92N1C2 TALEN induced mutation
tcaaccccatgtaccatcaatataatgcagagtaagccgagtaatcta

SEQ ID NO: 387 - DNA, 48 bp, Artificial Sequence
  synthetic zebrafish MiR-17-92N1C2 TALEN induced mutation
tcaaccccatgtaccatcaatacaatgcagagtaagccgagtaatcta

SEQ ID NO: 388 - DNA, 51 bp, Artificial Sequence
  synthetic zebrafish MiR-17-92N1C2 TALEN induced mutation
tcaaccccatgtaccatcaatatctaaatgcagagtaagccgagtaatcta

SEQ ID NO: 389 - DNA, 53 bp, Artificial Sequence
  synthetic zebrafish MiR-17-92N1C2 TALEN induced mutation
tcaaccccatgtaccatcaatatctaaaaatgcagagtaagccgagtaatcta

SEQ ID NO: 390 - DNA, 59 bp, Artificial Sequence
  synthetic zebrafish MiR-17-92N1C2 TALEN induced mutation
tcaaccccatgtcccatccatatccaatcataataatgcagagtaagccgagtaatcta

SEQ ID NO: 391 - DNA, 59 bp, Artificial Sequence
  synthetic zebrafish MiR-17-92N1C2 TALEN induced mutation
tcaaccccatgtaccatcaataatcaaatacaataatgcagagtaagccgagtaatcta

SEQ ID NO: 392 - DNA, 61 bp, Artificial Sequence
  synthetic zebrafish MiR-17-92N1C2 TALEN induced mutation
tcaaccccatgtaccatcaatatctatccatcaactaatgcagagtaagccgagtaatcta

SEQ ID NO: 393 - DNA, 75 bp, Artificial Sequence
  synthetic zebrafish MiR-17-92N1C2 TALEN induced mutation
tcaaccccatgtaccatcaatatcaaatatccaattgcaagatttgatcaaatgcagagtaagccgagtaatcta

SEQ ID NO: 394 - DNA, 42 bp, Artificial Sequence
  synthetic wild-type (WT) zebrafish MiR-17-92N2C2 TALEN binding region
tcaaatatttctccccttctgcagagtaagccgagtaatcta

SEQ ID NO: 395 - DNA, 45 bp, Artificial Sequence
  synthetic zebrafish MiR-17-92N2C2 TALEN induced mutation
tcaaatatttctccccttccccctcagagtaagccgagtaatcta

SEQ ID NO: 396 - DNA, 46 bp, Artificial Sequence
  synthetic zebrafish MiR-17-92N2C2 TALEN induced mutation
tcaaatatttctccccttccccctgcagagtaagccgagtaatcta

SEQ ID NO: 397 - DNA, 47 bp, Artificial Sequence
  synthetic zebrafish MiR-17-92N2C2 TALEN induced mutation
tcaaatatttctccccttcccagggaggaagtaagccgagtaatcta

SEQ ID NO: 398 - DNA, 48 bp, Artificial Sequence
  synthetic zebrafish MiR-17-92N2C2 TALEN induced mutation
tcaaatatttctccccttccccctcggcagagtaagccgagtaatcta

SEQ ID NO: 399 - DNA, 49 bp, Artificial Sequence
  synthetic zebrafish MiR-17-92N2C2 TALEN induced mutation
tcaaatatttctccccttccccctaatgcagagtaagccgagtaatcta

SEQ ID NO: 400 - DNA, 51 bp, Artificial Sequence
  synthetic zebrafish MiR-17-92N2C2 TALEN induced mutation
tcaaatatttctccccttccccctctaatgcagagtaagccgagtaatcta

SEQ ID NO: 401 - DNA, 52 bp, Artificial Sequence
  synthetic zebrafish MiR-17-92N2C2 TALEN induced mutation
tcaaatatttctttccttcccttccctcccccagagtaagccgagtaatcta

SEQ ID NO: 402 - DNA, 55 bp, Artificial Sequence
  synthetic zebrafish MiR-17-92N2C2 TALEN induced mutation
tcaaatatttctccccttccccctcttaaaaatgcagagtaagccgagtaatcta

SEQ ID NO: 403 - DNA, 59 bp, Artificial Sequence
  synthetic zebrafish MiR-17-92N2C2 TALEN induced mutation
tcaaatatttctccccttctcccccttcccccagaatgcagagtaagccgagtaatcta

SEQ ID NO: 404 - DNA, 54 bp, Artificial Sequence
  synthetic wild-type (WT) zebrafish MiR-430N1 TALEN binding region
ctaacgttacatgtaaatcaaatcatttgtttagtttttctactggacatgaac

SEQ ID NO: 405 - DNA, 54 bp, Artificial Sequence
  synthetic zebrafish MiR-430N1 TALEN induced mutation
ctaacgttacatgtaaatcaaattatttggttaatttttctacaggacatgaac

SEQ ID NO: 406 - DNA, 53 bp, Artificial Sequence
  synthetic zebrafish MiR-430N1 TALEN induced mutation
ctaacgttacatgtaaatcaaatcattgtttagtttttctactggacatgaac

SEQ ID NO: 407 - DNA, 51 bp, Artificial Sequence
  synthetic zebrafish MiR-430N1 TALEN induced mutation
ctaacgttacatgtaaatcaaatcaaattagtttttctactggacatgaac

SEQ ID NO: 408 - DNA, 50 bp, Artificial Sequence
  synthetic zebrafish MiR-430N1 TALEN induced mutation
ctaacgttacatgtaaatcaaatcatttagtttttctactggacatgaac

SEQ ID NO: 409 - DNA, 47 bp, Artificial Sequence
  synthetic zebrafish MiR-430N1 TALEN induced mutation
ctaacgttacatgtaaatcaaatttagtttttctactggacatgaac

SEQ ID NO: 410 - DNA, 44 bp, Artificial Sequence
  synthetic zebrafish MiR-430N1 TALEN induced mutation
ctaacgttacatgtaaatacatagtttttctactggacatgaac

SEQ ID NO: 411 - DNA, 30 bp, Artificial Sequence
  synthetic zebrafish MiR-430N1 TALEN induced mutation
ctaacgttagtttttctactggacatgaac

SEQ ID NO: 412 - DNA, 57 bp, Artificial Sequence
  synthetic wild-type (WT) zebrafish MiR-430N2 TALEN binding region
ttacatctgtattttaacattgttctaattaaacacagacactgtgactattcagaa

SEQ ID NO: 413 - DNA, 51 bp, Artificial Sequence
  synthetic zebrafish MiR-430N2 TALEN induced mutation
ttacatctgtattttaacattgtttaacacagacactgtgactattcagaa

SEQ ID NO: 414 - DNA, 51 bp, Artificial Sequence
  synthetic zebrafish MiR-430N2 TALEN induced mutation
ttacatctgtattttaacattgttaaacacagacactgtgactattcagaa

SEQ ID NO: 415 - DNA, 47 bp, Artificial Sequence
  synthetic zebrafish MiR-430N2 TALEN induced mutation
ttacatctgtattttaacattgttctagacactgtgactattcagaa

SEQ ID NO: 416 - DNA, 46 bp, Artificial Sequence
  synthetic zebrafish MiR-430N2 TALEN induced mutation
ttacatctgtattttaacattgttctgacactgtgactattcagaa

SEQ ID NO: 417 - DNA, 45 bp, Artificial Sequence
  synthetic zebrafish MiR-430N2 TALEN induced mutation
ttacatatgtattttaacattaacagacactgtgactattcagaa

SEQ ID NO: 418 - DNA, 41 bp, Artificial Sequence
  synthetic zebrafish MiR-430N2 TALEN induced mutation
ttacatctgtattttaacacagacactgtgactattcagaa

SEQ ID NO: 419 - DNA, 40 bp, Artificial Sequence
  synthetic zebrafish MiR-430N2 TALEN induced mutation
ttacatctgtattttaacattgttctgtgactattcagaa

SEQ ID NO: 420 - DNA, 38 bp, Artificial Sequence
  synthetic zebrafish MiR-430N2 TALEN induced mutation
ttacatatgtattttaacattgttctgactattcagaa

SEQ ID NO: 421 - DNA, 61 bp, Artificial Sequence
  synthetic zebrafish MiR-430N2 TALEN induced mutation
ttacatctgtattttaacattgttctgtcaatattttaacagacactgtgactattcagaa

SEQ ID NO: 422 - DNA, 62 bp, Artificial Sequence
  synthetic zebrafish MiR-430N2 TALEN induced mutation
ttacatctgtattttaacattgttcatctgtattttaacacagacactgtgactattcagaa

SEQ ID NO: 423 - DNA, 71 bp, Artificial Sequence
  synthetic zebrafish MiR-430N2 TALEN induced mutation
ttacatctgtattttaacattaacaattaaacattttaacaattaaacacagacactgtgactattcagaa

SEQ ID NO: 424 - DNA, 105 bp, Artificial Sequence
  synthetic zebrafish MiR-430N2 TALEN induced mutation
ttacatctgtattttaacattgttcattgcaattccatgccaaatgggttcagtcttgcttgttgtacgtgtccttataaacacagacactgtgactattcagaa

SEQ ID NO: 425 - DNA, 55 bp, Artificial Sequence
  synthetic wild-type (WT) zebrafish MiR-430C1 TALEN binding region
atacttttaataaaccccagggaattttgtcttcttggatggtgtaagaaatgag

SEQ ID NO: 426 - DNA, 52 bp, Artificial Sequence
  synthetic zebrafish MiR-430C1 TALEN induced mutation
atacttttaataaaccccagggaatttcttcttggatggtgtaagaaatgag

SEQ ID NO: 427 - DNA, 49 bp, Artificial Sequence
  synthetic zebrafish MiR-430C1 TALEN induced mutation
atacttttaataaaccccagggaatttcttggatggtgtaagaaatgag

SEQ ID NO: 428 - DNA, 47 bp, Artificial Sequence
  synthetic zebrafish MiR-430C1 TALEN induced mutation
atacttttaataaaccccagggaatcttggatggtgtaagaaatgag

SEQ ID NO: 429 - DNA, 62 bp, Artificial Sequence
  synthetic zebrafish MiR-430C1 TALEN induced mutation
atacttttaataaaccccagggaagaaccccagggaacttcttggatggtgtaagaaatgag

SEQ ID NO: 430 - DNA, 55 bp, Artificial Sequence
  synthetic wild-type (WT) zebrafish MiR-430C2 TALEN binding region
atccttaagaagtcaaaccatttgtattgaccgaggcaacagaatctgcatagag

SEQ ID NO: 431 - DNA, 50 bp, Artificial Sequence
  synthetic zebrafish MiR-430C2 TALEN induced mutation
atccttaagaagtcaaaccatgttgccgaggcaacagaatctgcatagag

SEQ ID NO: 432 - DNA, 48 bp, Artificial Sequence
  synthetic zebrafish MiR-430C2 TALEN induced mutation
atccttaagaagtcaaaccatttgtttggcaacagaatctgcatagag

SEQ ID NO: 433 - DNA, 47 bp, Artificial Sequence
  synthetic zebrafish MiR-430C2 TALEN induced mutation
atccttaagaagtcaaaccatctctatgcaacagaatctgcatagag

SEQ ID NO: 434 - DNA, 46 bp, Artificial Sequence
  synthetic zebrafish MiR-430C2 TALEN induced mutation
atccttaagaagtcaaaccaaccgaggcaacagaatctgcatagag

SEQ ID NO: 435 - DNA, 45 bp, Artificial Sequence
  synthetic zebrafish MiR-430C2 TALEN induced mutation
atccttaagaagtcaaaccaccgaggcaacagaatctgcatagag

SEQ ID NO: 436 - DNA, 45 bp, Artificial Sequence
  synthetic zebrafish MiR-430C2 TALEN induced mutation
atccttaagaagtcaaaccatcgaggcaacagaatctgcatagag

SEQ ID NO: 437 - DNA, 44 bp, Artificial Sequence
  synthetic zebrafish MiR-430C2 TALEN induced mutation
atccttaagaagtcaaaccatttggcaacagaatctgcatagag

SEQ ID NO: 438 - DNA, 42 bp, Artificial Sequence
  synthetic zebrafish MiR-430C2 TALEN induced mutation
atccttaagaagtcaaaccgaggcaacagaatctgcatagag

SEQ ID NO: 439 - DNA, 41 bp, Artificial Sequence
  synthetic zebrafish MiR-430C2 TALEN induced mutation
atccttaagaagtcaaaccaggcaacagaatctgcatagag

SEQ ID NO: 440 - DNA, 56 bp, Artificial Sequence
  synthetic zebrafish MiR-430C2 TALEN induced mutation
atccttaagaagtcaaaccatttgtatttgaccgaggcaacagaatctgcatagag

SEQ ID NO: 441 - DNA, 59 bp, Artificial Sequence
  synthetic zebrafish MiR-430C2 TALEN induced mutation
atccttaagaagtcaaaccatttgaggcaacacaccgaggcaacagaatctgcatagag

SEQ ID NO: 442 - DNA, 46 bp, Artificial Sequence
  synthetic wild-type (WT) zebrafish MiR-430N1C1 TALEN binding region
taacgttacatgtaaatcaaatcttcttggatggtgtaagaaatga

SEQ ID NO: 443 - DNA, 48 bp, Artificial Sequence
  synthetic zebrafish MiR-430N1C1 TALEN induced mutation
taacgttacatgtaaatcaaatcacttcttggatggtgtaagaaatga

SEQ ID NO: 444 - DNA, 48 bp, Artificial Sequence
  synthetic zebrafish MiR-430N1C1 TALEN induced mutation
taacgttacatgtaaatcaaatcatttcttggatggtgtaagaaatga

SEQ ID NO: 445 - DNA, 51 bp, Artificial Sequence
  synthetic zebrafish MiR-430N1C1 TALEN induced mutation
taacgttacatgtaaatcaaatcatttcttcttggatggtgtaagaaatga

SEQ ID NO: 446 - DNA, 53 bp, Artificial Sequence
  synthetic zebrafish MiR-430N1C1 TALEN induced mutation
taacgttacatgtaaatcaaatcattccccttcttggatggtgtaagaaatga

SEQ ID NO: 447 - DNA, 44 bp, Artificial Sequence
  synthetic wild-type (WT) zebrafish MiR-430N2C1 TALEN binding region
tacatctgtattttaacattgttcttggatggtgtaagaaatga

SEQ ID NO: 448 - DNA, 46 bp, Artificial Sequence
  synthetic zebrafish MiR-430N2C1 TALEN induced mutation
tacatctgtattttaacattgtcttcttggatggtgtaagaaatga

SEQ ID NO: 449 - DNA, 47 bp, Artificial Sequence
  synthetic zebrafish MiR-430N2C1 TALEN induced mutation
tacatctgtattttaacattgttcttcttggatggtgtaagaaatga

SEQ ID NO: 450 - DNA, 51 bp, Artificial Sequence
  synthetic zebrafish MiR-430N2C1 TALEN induced mutation
tacatctgtattttaacattgttctatcttcttggatggtgtaagaaatga

SEQ ID NO: 451 - DNA, 55 bp, Artificial Sequence
  synthetic zebrafish MiR-430N2C1 TALEN induced mutation
tacatctgtattttaacattgttattattgtcttcttggatggtgtaagaaatga

SEQ ID NO: 452 - DNA, 45 bp, Artificial Sequence
  synthetic wild-type (WT) zebrafish MiR-430N1C2 TALEN binding region
taacgttacatgtaaatcaaatcgaggcaacagaatctgcataga

SEQ ID NO: 453 - DNA, 47 bp, Artificial Sequence
  synthetic zebrafish MiR-430N1C2 TALEN induced mutation
taacgttacatgtaaatcaaatccgaggcaacagaatctgcatagag

SEQ ID NO: 454 - DNA, 48 bp, Artificial Sequence
  synthetic zebrafish MiR-430N1C2 TALEN induced mutation
taacgttacatgtaaatcaaatcaccgaggcaacagaatctgcataga

SEQ ID NO: 455 - DNA, 48 bp, Artificial Sequence; identical to SEQ ID NO: 454
  synthetic zebrafish MiR-430N1C2 TALEN induced mutation

SEQ ID NO: 456 - DNA, 61 bp, Artificial Sequence
  synthetic zebrafish MiR-430N1C2 TALEN induced mutation
taacgttacatgtaaatcaaatcagtttgttaggacaccgaggcaacagaatctgcataga

SEQ ID NO: 457 - DNA, 47 bp, Artificial Sequence
  synthetic wild-type (WT) zebrafish MiR-430N2C2 TALEN binding region
tacatctgtattttaacattgttccgaggcaacagaatctgcataga

SEQ ID NO: 458 - DNA, 48 bp, Artificial Sequence
  synthetic zebrafish MiR-430N2C2 TALEN induced mutation
tacatctgtattttaacattgttctacaggcaacagaatctgcataga

SEQ ID NO: 459 - DNA, 55 bp, Artificial Sequence
  synthetic zebrafish MiR-430N2C2 TALEN induced mutation
tacatctgtattttaacattgttgttaaaacaatgttaaacagaatctgcataga

SEQ ID NO: 460 - DNA, 55 bp, Artificial Sequence
  synthetic zebrafish MiR-430N2C2 TALEN induced mutation
tacatctgtattttaacattgttctaattgaccgaggcaacagaatctgcataga

SEQ ID NO: 461 - DNA, 58 bp, Artificial Sequence
  synthetic zebrafish MiR-430N2C2 TALEN induced mutation
tacatctgtattttaacattgtttaacaatgttgccgaggcaacagaatctgcataga

SEQ ID NO: 462 - DNA, 17 bp, Artificial Sequence
  synthetic wild-type (WT) zebrafish Gria3a TALEN binding region
tcgtccaatagcttctc

SEQ ID NO: 463 - DNA, 16 bp, Artificial Sequence
  synthetic zebrafish Gria3a TALEN induced mutation
tgtccaatagcttctc

SEQ ID NO: 464 - DNA, 16 bp, Artificial Sequence
  synthetic zebrafish Gria3a TALEN induced mutation
tctccaatagcttctc

SEQ ID NO: 465 - DNA, 16 bp, Artificial Sequence
  synthetic zebrafish Gria3a TALEN induced mutation
tcgtccatagcttctc

SEQ ID NO: 466 - DNA, 16 bp, Artificial Sequence
  synthetic zebrafish Gria3a TALEN induced mutation
tcgtccaaagcttctc

SEQ ID NO: 467 - DNA, 16 bp, Artificial Sequence
  synthetic zebrafish Gria3a TALEN induced mutation
tcgtccaatagcttcc

SEQ ID NO: 468 - DNA, 17 bp, Artificial Sequence
  synthetic zebrafish Gria3a TALEN induced mutation
tagtccaatagcttctc

SEQ ID NO: 469 - DNA, 17 bp, Artificial Sequence
  synthetic zebrafish Gria3a TALEN induced mutation
ttgtccaatagcttctc

SEQ ID NO: 470 - DNA, 17 bp, Artificial Sequence
  synthetic zebrafish Gria3a TALEN induced mutation
tggtccaatagcttctc

SEQ ID NO: 471 - DNA, 17 bp, Artificial Sequence
  synthetic zebrafish Gria3a TALEN induced mutation
tcatccaatagcttctc

SEQ ID NO: 472 - DNA, 17 bp, Artificial Sequence
  synthetic zebrafish Gria3a TALEN induced mutation
tcttccaatagcttctc

SEQ ID NO: 473 - DNA, 17 bp, Artificial Sequence
  synthetic zebrafish Gria3a TALEN induced mutation
tcctccaatagcttctc

SEQ ID NO: 474 - DNA, 17 bp, Artificial Sequence
  synthetic zebrafish Gria3a TALEN induced mutation
tcgtccattagcttctc

SEQ ID NO: 475 - DNA, 17 bp, Artificial Sequence
  synthetic zebrafish Gria3a TALEN induced mutation
tcgtccactagcttctc

SEQ ID NO: 476 - DNA, 17 bp, Artificial Sequence
  synthetic zebrafish Gria3a TALEN induced mutation
tcgtccagtagcttctc

SEQ ID NO: 477 - DNA, 17 bp, Artificial Sequence
  synthetic zebrafish Gria3a TALEN induced mutation
tcgtccaaaagcttctc

SEQ ID NO: 478 - DNA, 17 bp, Artificial Sequence
  synthetic zebrafish Gria3a TALEN induced mutation
tcgtccaacagcttctc

SEQ ID NO: 479 - DNA, 17 bp, Artificial Sequence
  synthetic zebrafish Gria3a TALEN induced mutation
tcgtccaagagcttctc

SEQ ID NO: 480 - DNA, 17 bp, Artificial Sequence
  synthetic zebrafish Gria3a TALEN induced mutation
tcgtccaatagcttcac

SEQ ID NO: 481 - DNA, 17 bp, Artificial Sequence
  synthetic zebrafish Gria3a TALEN induced mutation
tcgtccaatagcttccc

SEQ ID NO: 482 - DNA, 17 bp, Artificial Sequence
  synthetic zebrafish Gria3a TALEN induced mutation
tcgtccaatagcttcgc

SEQ ID NO: 483 - DNA, 17 bp, Artificial Sequence
  synthetic zebrafish Gria3a TALEN induced mutation
tcgtccaatagcttcta

SEQ ID NO: 484 - DNA, 17 bp, Artificial Sequence
  synthetic zebrafish Gria3a TALEN induced mutation
tcgtccaatagcttctt

SEQ ID NO: 485 - DNA, 17 bp, Artificial Sequence
  synthetic zebrafish Gria3a TALEN induced mutation
tcgtccaatagcttctg

SEQ ID NO: 486 - DNA, 50 bp, Artificial Sequence
  synthetic Xenopus tropicalis  ptf1a/p48 target sequence for TALEN with ELD FokI nuclease domain
ttcactgaccattcctctagggacgccctggacccagacgactttttgga

SEQ ID NO: 487 - DNA, 50 bp, Artificial Sequence
  synthetic Xenopus tropicalis  ptf1a/p48 target sequence for TALEN with KKR FokI nuclease domain
tccaaaaagtcgtctgggtccagggcgtccctagaggaatggtcagtgaa

SEQ ID NO: 488 - DNA, 42 bp, Artificial Sequence
  synthetic Xenopus tropicalis  ptf1a/p48 target sequence for zinc finger nuclease (ZFN)
tggagtccttcccttccccgtacttcgatgaggatgatttct

SEQ ID NO: 489 - DNA, 42 bp, Artificial Sequence
  synthetic Xenopus tropicalis  ptf1a/p48 target sequence for zinc finger nuclease (ZFN)
agaaatcatcctcatcgaagtacggggaagggaaggactcca

SEQ ID NO: 490 - DNA, 50 bp, Artificial Sequence
  synthetic wild-type (WT) Xenopus tropicalis noggin TALEN binding region
tcctagtgaaaacctaccactggtggaccttattgagcatccggatccta

SEQ ID NO: 491 - DNA, 16 bp, Artificial Sequence
  synthetic Xenopus tropicalis noggin TALEN induced mutation
tcctagtgaaaaccta

SEQ ID NO: 492 - DNA, 26 bp, Artificial Sequence
  synthetic Xenopus tropicalis noggin TALEN induced mutation
gtcttcctgggaggagagacttggag

SEQ ID NO: 493 - DNA, 23 bp, Artificial Sequence
  synthetic Xenopus tropicalis noggin TALEN induced mutation
ccttattgagcatccggatccta

SEQ ID NO: 494 - DNA, 24 bp, Artificial Sequence
  synthetic Xenopus tropicalis noggin TALEN induced mutation
tcctagttgagcatccggatccta

SEQ ID NO: 495 - DNA, 34 bp, Artificial Sequence
  synthetic Xenopus tropicalis noggin TALEN induced mutation
tcctagtgaaaacctactgagcttccggatccta

SEQ ID NO: 496 - DNA, 34 bp, Artificial Sequence
  synthetic Xenopus tropicalis noggin TALEN induced mutation
tcctagtgaaaacctattgagcatccggatccta

SEQ ID NO: 497 - DNA, 35 bp, Artificial Sequence
  synthetic Xenopus tropicalis noggin TALEN induced mutation
tcctagtgaaaaccttattgagcatccggatccta

SEQ ID NO: 498 - DNA, 37 bp, Artificial Sequence
  synthetic Xenopus tropicalis noggin TALEN induced mutation
tcctagtgaaaacctaccactgagcatccggatccta

SEQ ID NO: 499 - DNA, 39 bp, Artificial Sequence
  synthetic Xenopus tropicalis noggin TALEN induced mutation
tcctagtgaaaacctaccttattgagcatccggatccta

SEQ ID NO: 500 - DNA, 41 bp, Artificial Sequence
  synthetic Xenopus tropicalis noggin TALEN induced mutation
tcctagtgaaaactaggatgcttattgagcatccggatcct

SEQ ID NO: 501 - DNA, 42 bp, Artificial Sequence
  synthetic Xenopus tropicalis noggin TALEN induced mutation
tcctagtgaaaacctaccactttattgagcatccggatccta

SEQ ID NO: 502 - DNA, 42 bp, Artificial Sequence
  synthetic Xenopus tropicalis noggin TALEN induced mutation
tcctagtgaaaacctaccaccttattgagcatccggatccta

SEQ ID NO: 503 - DNA, 43 bp, Artificial Sequence
  synthetic Xenopus tropicalis noggin TALEN induced mutation
tcctagtgaaaacctaccactggtattgagcatccggatccta

SEQ ID NO: 504 - DNA, 44 bp, Artificial Sequence
  synthetic Xenopus tropicalis noggin TALEN induced mutation
tcctagtgaaaacctacctcaccttattgagcatccggatccta

SEQ ID NO: 505 - DNA, 46 bp, Artificial Sequence
  synthetic Xenopus tropicalis noggin TALEN induced mutation
tcctagtgaaaacctaccacctaccttattgagcatccggatccta

SEQ ID NO: 506 - DNA, 50 bp, Artificial Sequence
  synthetic Xenopus tropicalis noggin TALEN induced mutation
tcctagtgaaaacctaccactaccacctaccaccttattgagcatccgga

SEQ ID NO: 507 - DNA, 50 bp, Artificial Sequence; identical to SEQ ID NO: 486
  synthetic wild-type (WT) Xenopus tropicalis ptf1a/p48 TALEN binding region

SEQ ID NO: 508 - DNA, 24 bp, Artificial Sequence
  synthetic Xenopus tropicalis ptf1a/p48 TALEN induced mutation
tctggacccagacgactttttgga

SEQ ID NO: 509 - DNA, 18 bp, Artificial Sequence
  synthetic Xenopus tropicalis ptf1a/p48 TALEN induced mutation
cccagacgactttttgga

SEQ ID NO: 510 - DNA, 31 bp, Artificial Sequence
  synthetic Xenopus tropicalis ptf1a/p48 TALEN induced mutation
ttcactgaccattcccagacgactttttgga

SEQ ID NO: 511 - DNA, 39 bp, Artificial Sequence
  synthetic Xenopus tropicalis ptf1a/p48 TALEN induced mutation
ttcactgaccattcctctggacccagacgactttttgga

SEQ ID NO: 512 - DNA, 40 bp, Artificial Sequence
  synthetic Xenopus tropicalis ptf1a/p48 TALEN induced mutation
ttcactgaccattcctctaggacccagacgactttttgga

SEQ ID NO: 513 - DNA, 40 bp, Artificial Sequence
  synthetic Xenopus tropicalis ptf1a/p48 TALEN induced mutation
ttcactgaccattcctcctggacccagacgactttttgga

SEQ ID NO: 514 - DNA, 45 bp, Artificial Sequence
  synthetic Xenopus tropicalis ptf1a/p48 TALEN induced mutation
ttcactgaccattcctctaggaatggacccagacgactttttgga

SEQ ID NO: 515 - DNA, 46 bp, Artificial Sequence
  synthetic Xenopus tropicalis ptf1a/p48 TALEN induced mutation
ttcactgaccattcctctagggaatggacccagacgactttttgga

SEQ ID NO: 516 - DNA, 49 bp, Artificial Sequence
  synthetic Xenopus tropicalis ptf1a/p48 TALEN induced mutation
ttcactgaccattcctctagggagccctggacccagacgactttttgga

SEQ ID NO: 517 - DNA, 50 bp, Artificial Sequence
  synthetic wild-type (WT) Xenopus tropicalis ets1 TALEN binding region
ttactctgaaaggagtggactttcagaagttctgtatgagcggagcagca

SEQ ID NO: 518 - DNA, 23 bp, Artificial Sequence
  synthetic Xenopus tropicalis ets1 TALEN induced mutation
ttactctgaaaggagtggacttt

SEQ ID NO: 519 - DNA, 16 bp, Artificial Sequence
  synthetic Xenopus tropicalis ets1 TALEN induced mutation
tatgagcggagcagca

SEQ ID NO: 520 - DNA, 25 bp, Artificial Sequence
  synthetic Xenopus tropicalis ets1 TALEN induced mutation
ttactctgaaaggagcggagcagca

SEQ ID NO: 521 - DNA, 31 bp, Artificial Sequence
  synthetic Xenopus tropicalis ets1 TALEN induced mutation
ttactctgaaaggagtatgagcggagcagca

SEQ ID NO: 522 - DNA, 33 bp, Artificial Sequence
  synthetic Xenopus tropicalis ets1 TALEN induced mutation
ttactctgaaaggagcgtatgagcggagcagca

SEQ ID NO: 523 - DNA, 33 bp, Artificial Sequence
  synthetic Xenopus tropicalis ets1 TALEN induced mutation
ttactctgaaaggagtggatgagcggagcagca

SEQ ID NO: 524 - DNA, 38 bp, Artificial Sequence
  synthetic Xenopus tropicalis ets1 TALEN induced mutation
ttactctgaaaggagtggactgtatgagcggagcagca

SEQ ID NO: 525 - DNA, 38 bp, Artificial Sequence
  synthetic Xenopus tropicalis ets1 TALEN induced mutation
ttactctgaaaggagtgttctgtatgagcggagcagca

SEQ ID NO: 526 - DNA, 39 bp, Artificial Sequence
  synthetic Xenopus tropicalis ets1 TALEN induced mutation
ttactctgaaaggagtggctctgtatgagcggagcagca

SEQ ID NO: 527 - DNA, 39 bp, Artificial Sequence
  synthetic Xenopus tropicalis ets1 TALEN induced mutation
ttactctgaaaggagtggttctgtatgagcggagcagca

SEQ ID NO: 528 - DNA, 39 bp, Artificial Sequence
  synthetic Xenopus tropicalis ets1 TALEN induced mutation
ttactctgaaaggagtagttctgtatgagcggagcagca

SEQ ID NO: 529 - DNA, 40 bp, Artificial Sequence
  synthetic Xenopus tropicalis ets1 TALEN induced mutation
ttactctgaaaggagtggactctgtatgagcggagcagca

SEQ ID NO: 530 - DNA, 41 bp, Artificial Sequence
  synthetic Xenopus tropicalis ets1 TALEN induced mutation
ttactctgaaaggagtggagctctgtatgagcggagcagca

SEQ ID NO: 531 - DNA, 41 bp, Artificial Sequence
  synthetic Xenopus tropicalis ets1 TALEN induced mutation
ttactctgaaaggagtggacttctgtatgagcggagcagca

SEQ ID NO: 532 - DNA, 43 bp, Artificial Sequence
  synthetic Xenopus tropicalis ets1 TALEN induced mutation
ttactctgaaaggagtactcagttctgtatgagcggagcagca

SEQ ID NO: 533 - DNA, 43 bp, Artificial Sequence
  synthetic Xenopus tropicalis ets1 TALEN induced mutation
ttactctgaaaggagtggactgttctgtatgagcggagcagca

SEQ ID NO: 534 - DNA, 43 bp, Artificial Sequence
  synthetic Xenopus tropicalis ets1 TALEN induced mutation
ttactctgaaaggagtggacttttctgtatgagcggagcagca

SEQ ID NO: 535 - DNA, 44 bp, Artificial Sequence
  synthetic Xenopus tropicalis ets1 TALEN induced mutation
ttactctgaaaggagtggacttgttctgtatgagcggagcagca

SEQ ID NO: 536 - DNA, 45 bp, Artificial Sequence
  synthetic Xenopus tropicalis ets1 TALEN induced mutation
ttactctgaaaggagtggacaaagttctgtatgagcggagcagca

SEQ ID NO: 537 - DNA, 46 bp, Artificial Sequence
  synthetic Xenopus tropicalis ets1 TALEN induced mutation
ttactctgaaaggagtggacttatgttatgtatgagcggagcagca

SEQ ID NO: 538 - DNA, 46 bp, Artificial Sequence
  synthetic Xenopus tropicalis ets1 TALEN induced mutation
ttactctgaaaggagtggacttttgttctgtatgagcggagcagca

SEQ ID NO: 539 - DNA, 47 bp, Artificial Sequence
  synthetic Xenopus tropicalis ets1 TALEN induced mutation
ttactctgaaaggagtggactgtaagttctgtatgagcggagcagca

SEQ ID NO: 540 - DNA, 52 bp, Artificial Sequence
  synthetic wild-type (WT) Xenopus tropicalis zinc finger nuclease (ZFN) noggin binding region
ggaccttattgagcatccggatcctatctatgatcccaaggagaaggatctt

SEQ ID NO: 541 - DNA, 23 bp, Artificial Sequence
  synthetic Xenopus tropicalis noggin zinc finger nuclease (ZFN) induced mutation
acctaccacatcctagggaccag

SEQ ID NO: 542 - DNA, 26 bp, Artificial Sequence
  synthetic Xenopus tropicalis noggin zinc finger nuclease (ZFN) induced mutation
cttattgagcatccactttgacccca

SEQ ID NO: 543 - DNA, 29 bp, Artificial Sequence
  synthetic Xenopus tropicalis noggin zinc finger nuclease (ZFN) induced mutation
ggaccttattgagcaaggagaaggatctt

SEQ ID NO: 544 - DNA, 38 bp, Artificial Sequence
  synthetic Xenopus tropicalis noggin zinc finger nuclease (ZFN) induced mutation
ggaccttattgagcatccggatcaaggagaaggatctt

SEQ ID NO: 545 - DNA, 39 bp, Artificial Sequence
  synthetic Xenopus tropicalis noggin zinc finger nuclease (ZFN) induced mutation
ggaccttattgaggaccttctcccaaggagaaggatctt

SEQ ID NO: 546 - DNA, 44 bp, Artificial Sequence
  synthetic wild-type (WT) Xenopus tropicalis zinc finger nuclease (ZFN) ptf1a/p48 binding region
ctggagtccttcccttccccgtacttcgatgaggatgatttctt

SEQ ID NO: 547 - DNA, 22 bp, Artificial Sequence
  synthetic Xenopus tropicalis ptf1a/p48 zinc finger nuclease (ZFN) induced mutation
tcttcgatgaggatgatttctt

SEQ ID NO: 548 - DNA, 28 bp, Artificial Sequence
  synthetic Xenopus tropicalis ptf1a/p48 zinc finger nuclease (ZFN) induced mutation
ctggagtccttcccttcgatgatttctt

SEQ ID NO: 549 - DNA, 34 bp, Artificial Sequence
  synthetic Xenopus tropicalis ptf1a/p48 zinc finger nuclease (ZFN) induced mutation
ctggagtccttcccttcgatgaggatgatttctt

SEQ ID NO: 550 - DNA, 34 bp, Artificial Sequence
  synthetic Xenopus tropicalis ptf1a/p48 zinc finger nuclease (ZFN) induced mutation
ctggaatccttcccttcgatgaggatgatttctt

SEQ ID NO: 551 - DNA, 35 bp, Artificial Sequence
  synthetic Xenopus tropicalis ptf1a/p48 zinc finger nuclease (ZFN) induced mutation
ctggagtccttcccttccgatgaggatgatttctt

SEQ ID NO: 552 - DNA, 36 bp, Artificial Sequence
  synthetic Xenopus tropicalis ptf1a/p48 zinc finger nuclease (ZFN) induced mutation
ctggagtccttcccttcctgatgaggatgatttctt

SEQ ID NO: 553 - DNA, 38 bp, Artificial Sequence
  synthetic Xenopus tropicalis ptf1a/p48 zinc finger nuclease (ZFN) induced mutation
ctggagtccttcccttccttcaatgaggatgatttctt

SEQ ID NO: 554 - DNA, 39 bp, Artificial Sequence
  synthetic Xenopus tropicalis ptf1a/p48 zinc finger nuclease (ZFN) induced mutation
ctggagtccttcccttcccttcgatgaggatgatttctt

SEQ ID NO: 555 - DNA, 938 bp, Artificial Sequence
  synthetic Xenopus tropicalis noggin TALEN-targeted sequence
ggtgatcgagctgaaagtgaagaatatttaagagaggggaggctggaggcagcaggcagacacagtggtgccaccaagggctgtgcgtaaggggcaggggagacagacggggctctgaacttccacttgtctgcaatgagaggggggtgcccctgaacccccccaattcctcctctgatgcattatttatgatctctggcaagaaatcgggagcaccctactcttatattgtgcagctgtgtgcagcatggatcattcccagtgccttgtgactatatatgctctcatggtcttcctgggacttagaatagaccaggggggctgccaacattatctgcacatcagaccagctcctagtgaaaacctaccactggtggaccttattgagcatccggatcctatctatgatcccaaggagaaggatcttaatgagaccttgctgaggactttaatggttggccactttgaccccaactttatggccatcaacctgccggaggagagacttggagtggaggaccttggggagttggatctccttcttaggcagaagccctcaggggcaatgccagcagaaatcaaaggactggaattttatgaggggcttcagggcaaaaagcacagactgagcaagaaactcaggagaaagttgcagatgtggctctggtcccagaccttctgtcctgtcctttacacatggaatgacctagggaccaggttttggcctcgctatgtgaaagtaggtagctgctacagtaagaggtcttgttctgtgccagagggcatggtttgcaaagctgccaagtctatgcatttgaccatcttaaggtggagatgtcaacgcagggttcagcagaagtgtgcatggataaccattcagtaccctgtcatatctgagtgcaaatgttcatgttgagactcttggactaatgcaaaag

SEQ ID NO: 556 - DNA, 990 bp, Artificial Sequence
  synthetic Xenopus tropicalis ptf1a/p48 TALEN-targeted sequence
gcagaagcgcaatgctatgtactataaagctacacggcgcagtatggtgctgctctctgtatactcagcgctctccctattctgtgcagcatcccagtgccacatactaggggacaggaaaccccctggcacccagtaacatacagtaaggatgtcggtgccattcccggtgcctgggaggagctgtcagtcgctgttactggtgcctacaggagatgccaggggattctctgccccaaagcgcagatctgacagggaccatgtgggcacccgatgcgccgagagctgtcactgtaccaggaggcgtgtcccccggggcccctcccaccaggcaaggtgctgaagcggagagggggaggcaatggagcactgtgattggctgcggctgcgggcattggcacgcttgctgcttgtacctataagtactcccgtgtgggacttcaacttcagcctcaaagtcccgaaccgagtgaggagcccccggaaccgcagcatcacccgggccggcaccatggaaacggtactggagcagttcgcagggctggagtccttcccttccccgtacttcgatgaggatgatttcttcactgaccattcctctagggacgccctggacccagacgactttttggaagacgatgtggacttcttggccggtcagatccaagactattaccgggacagccgggggctgcacactgatgatgaatactgcgatgccggcaacttctccttctcatcctcctcttcggggggcttcccctatgaatgtggggagggaggctgcgaattgtcgccggggatgaagggagggagtctggtgatgaagaggaggaggaggctgaggtcggacgcggagatgcagcagctcaggcaggcggccaatgtcagggagcggcgcaggatgcagtccatcaatgacgcctttgaggggctccgctcgcacatccccactctgccctacgagaagcgactgtccaaggtagacac

SEQ ID NO: 557 - DNA, 201 bp, Artificial Sequence
  synthetic Xenopus laevis ets1a TALEN-targeted sequence
atccccgagaatggacagacatgcatgtgagagagtgggtctcgtgggcagtgaatgaatttactctgaaaggagtggactttcagaagttctgtatgagcggagcagcattatgtgccctggggaaggaatgcttcctagaactggcaccagactttgtgggagatatcttatgggagcacttggagatcttgcagaaag

SEQ ID NO: 558 - DNA, 50 bp, Artificial Sequence
  synthetic wild-type (WT) Xenopus tropicalis hhex TALEN binding region
ttacaactgtgcacattaactgctgctcagtaagaatggacctctcttca

SEQ ID NO: 559 - DNA, 19 bp, Artificial Sequence
  synthetic Xenopus tropicalis hhex TALEN induced mutation
ttacaactgtgcacattaa

SEQ ID NO: 560 - DNA, 25 bp, Artificial Sequence
  synthetic Xenopus tropicalis hhex TALEN induced mutation
ttacaactgtgcacatctctcttca

SEQ ID NO: 561 - DNA, 28 bp, Artificial Sequence
  synthetic Xenopus tropicalis hhex TALEN induced mutation
ttacaactgtgcacattaactctcttca

SEQ ID NO: 562 - DNA, 34 bp, Artificial Sequence
  synthetic Xenopus tropicalis hhex TALEN induced mutation
ttacaactgtgcacattaactggacctctcttca

SEQ ID NO: 563 - DNA, 36 bp, Artificial Sequence
  synthetic Xenopus tropicalis hhex TALEN induced mutation
ttacaactgtgcacattaagaatggacctctcttca

SEQ ID NO: 564 - DNA, 39 bp, Artificial Sequence
  synthetic Xenopus tropicalis hhex TALEN induced mutation
ttacaactgtgcacatcagctggaatggacctctcttca

SEQ ID NO: 565 - DNA, 38 bp, Artificial Sequence
  synthetic Xenopus tropicalis hhex TALEN induced mutation
ttacaactgtgcacattaactgaatggacctctcttca

SEQ ID NO: 566 - DNA, 39 bp, Artificial Sequence
  synthetic Xenopus tropicalis hhex TALEN induced mutation
ttacaactgtgcacattaactgaaatggacctctcttca

SEQ ID NO: 567 - DNA, 39 bp, Artificial Sequence
  synthetic Xenopus tropicalis hhex TALEN induced mutation
ttacaactgtgcacatcagtaagaatggacctctcttca

SEQ ID NO: 568 - DNA, 42 bp, Artificial Sequence
  synthetic Xenopus tropicalis hhex TALEN induced mutation
ttacaactgtgcacagtaacagtaagaatggacctctcttca

SEQ ID NO: 569 - DNA, 42 bp, Artificial Sequence
  synthetic Xenopus tropicalis hhex TALEN induced mutation
ttacaactgtgcacattaagagtaagaatggacctctcttca

SEQ ID NO: 570 - DNA, 42 bp, Artificial Sequence
  synthetic Xenopus tropicalis hhex TALEN induced mutation
ttacaactgtgcacattaacagtaagaatggacctctcttca

SEQ ID NO: 571 - DNA, 47 bp, Artificial Sequence
  synthetic Xenopus tropicalis hhex TALEN induced mutation
ttacaactgtgcacattaactgctcagtaagaatggacctctcttca

SEQ ID NO: 572 - DNA, 50 bp, Artificial Sequence
  synthetic Xenopus tropicalis hhex TALEN induced mutation
ttacaactgtgcacattaactgcatttactgcattaaccgcagtaagaat

SEQ ID NO: 573 - DNA, 50 bp, Artificial Sequence
  synthetic Xenopus tropicalis hhex TALEN induced mutation
ttacaactgtgcacattaactgcagcacattaactcagtaagaatggacc

SEQ ID NO: 574 - DNA, 50 bp, Artificial Sequence
  synthetic Xenopus tropicalis hhex TALEN induced mutation
ttacaactgtgcacattaactgcacattaactcagtaagaatggacctct

SEQ ID NO: 575 - DNA, 51 bp, Artificial Sequence
  synthetic wild-type (WT) Xenopus tropicalis vpp1 TALEN binding region
tcagtcttggccttcaggataaacttcatgcccctacagcaaactggggga

SEQ ID NO: 576 - DNA, 24 bp, Artificial Sequence
  synthetic Xenopus tropicalis vpp1 TALEN induced mutation
tcagtcttggccttcaggataaac

SEQ ID NO: 577 - DNA, 29 bp, Artificial Sequence
  synthetic Xenopus tropicalis vpp1 TALEN induced mutation
tcagtcttggccttcagcaaactggggga

SEQ ID NO: 578 - DNA, 30 bp, Artificial Sequence
  synthetic Xenopus tropicalis vpp1 TALEN induced mutation
tcagtcttgcccctacagcaaactggggga

SEQ ID NO: 579 - DNA, 30 bp, Artificial Sequence
  synthetic Xenopus tropicalis vpp1 TALEN induced mutation
tcagtcttggccctacagcaaactggggga

SEQ ID NO: 580 - DNA, 37 bp, Artificial Sequence
  synthetic Xenopus tropicalis vpp1 TALEN induced mutation
tcagtcttggccttcaggcctacagcaaactggggga

SEQ ID NO: 581 - DNA, 38 bp, Artificial Sequence
  synthetic Xenopus tropicalis vpp1 TALEN induced mutation
tcagtcttggccttcaggataaacagcaaactggggga

SEQ ID NO: 582 - DNA, 42 bp, Artificial Sequence
  synthetic Xenopus tropicalis vpp1 TALEN induced mutation
tcagtcttggcccccagtttgcccctacagcaaactggggga

SEQ ID NO: 583 - DNA, 44 bp, Artificial Sequence
  synthetic Xenopus tropicalis vpp1 TALEN induced mutation
tcagtcttggcctacagcaagtttgcctacagcaaactggggga

SEQ ID NO: 584 - DNA, 43 bp, Artificial Sequence
  synthetic Xenopus tropicalis vpp1 TALEN induced mutation
tcagtcttggccttcagtcttggcccctacagcaaactggggg

SEQ ID NO: 585 - DNA, 42 bp, Artificial Sequence
  synthetic Xenopus tropicalis vpp1 TALEN induced mutation
tcagtcttggccttcaggatgcccctacagcaaactggggga

SEQ ID NO: 586 - DNA, 44 bp, Artificial Sequence
  synthetic Xenopus tropicalis vpp1 TALEN induced mutation
tcagtcttggccttcaggatatgcccctacagcaaactggggga

SEQ ID NO: 587 - DNA, 44 bp, Artificial Sequence
  synthetic Xenopus tropicalis vpp1 TALEN induced mutation
tcagtcttggccttcaggataaacccctacagcaaactggggga

SEQ ID NO: 588 - DNA, 44 bp, Artificial Sequence; identical to SEQ ID NO: 587
  synthetic Xenopus tropicalis vpp1 TALEN induced mutation

SEQ ID NO: 589 - DNA, 46 bp, Artificial Sequence
  synthetic Xenopus tropicalis vpp1 TALEN induced mutation
tcagtcttggccttcaggataaactatcctacagcaaactggggga

SEQ ID NO: 590 - DNA, 50 bp, Artificial Sequence
  synthetic wild-type (WT) Xenopus tropicalis foxd3 TALEN binding region
tgttcgacaatggcagtttcctcaggagaaggaagcgctttaagagacaa

SEQ ID NO: 591 - DNA, 19 bp, Artificial Sequence
  synthetic Xenopus tropicalis foxd3 TALEN induced mutation
aaagcgctttaagagacaa

SEQ ID NO: 592 - DNA, 24 bp, Artificial Sequence
  synthetic Xenopus tropicalis foxd3 TALEN induced mutation
agaaggaagcgctttaagagacaa

SEQ ID NO: 593 - DNA, 29 bp, Artificial Sequence
  synthetic Xenopus tropicalis foxd3 TALEN induced mutation
tgttcgacaatggcagttttaagagacaa

SEQ ID NO: 594 - DNA, 31 bp, Artificial Sequence
  synthetic Xenopus tropicalis foxd3 TALEN induced mutation
tgttcgacaatggaagcgctttaagagacaa

SEQ ID NO: 595 - DNA, 31 bp, Artificial Sequence
  synthetic Xenopus tropicalis foxd3 TALEN induced mutation
tgttcgacaatggcagcgctttaagagacaa

SEQ ID NO: 596 - DNA, 35 bp, Artificial Sequence
  synthetic Xenopus tropicalis foxd3 TALEN induced mutation
tgttcgacaatggcaggaagcgctttaagagacaa

SEQ ID NO: 597 - DNA, 35 bp, Artificial Sequence
  synthetic Xenopus tropicalis foxd3 TALEN induced mutation
tgttcgacaatggcagtttcctctttaagagacaa

SEQ ID NO: 598 - DNA, 36 bp, Artificial Sequence
  synthetic Xenopus tropicalis foxd3 TALEN induced mutation
tgttcgacaatggcagtttcctgctttgagagacaa

SEQ ID NO: 599 - DNA, 38 bp, Artificial Sequence
  synthetic Xenopus tropicalis foxd3 TALEN induced mutation
tgttcgacaatggcagaaggaagcgctttaagagacaa

SEQ ID NO: 600 - DNA, 38 bp, Artificial Sequence
  synthetic Xenopus tropicalis foxd3 TALEN induced mutation
tgttcgacaatggcagtttcctgcgctttaagagacaa

SEQ ID NO: 601 - DNA, 50 bp, Artificial Sequence
  synthetic wild-type (WT) Xenopus tropicalis sox9 TALEN binding region
tttcctgtgtgcatcagagaggcggtcagccaggtgctgaagggatatga

SEQ ID NO: 602 - DNA, 38 bp, Artificial Sequence
  synthetic Xenopus tropicalis sox9 TALEN induced mutation
tttcctgtgtgcatcagccaggtgctgaagggatatga

SEQ ID NO: 603 - DNA, 42 bp, Artificial Sequence
  synthetic Xenopus tropicalis sox9 TALEN induced mutation
tttcctgtgtgcatcagagagccaggtgctgaagggatatga

SEQ ID NO: 604 - DNA, 42 bp, Artificial Sequence
  synthetic Xenopus tropicalis sox9 TALEN induced mutation
tttcctgtgtgcatcagagaggcaggtgctgaagggatatga

SEQ ID NO: 605 - DNA, 42 bp, Artificial Sequence
  synthetic Xenopus tropicalis sox9 TALEN induced mutation
tttcctgtgtgcatcagagaggcgggtgctgaagggatatga

SEQ ID NO: 606 - DNA, 45 bp, Artificial Sequence
  synthetic Xenopus tropicalis sox9 TALEN induced mutation
tttcctgtgtgcatcccatcatcatcatatgctgaagggatatga

SEQ ID NO: 607 - DNA, 45 bp, Artificial Sequence
  synthetic Xenopus tropicalis sox9 TALEN induced mutation
tttcctgtgtgcatcagagaggtgccaggcgctgaagggatatga

SEQ ID NO: 608 - DNA, 45 bp, Artificial Sequence
  synthetic Xenopus tropicalis sox9 TALEN induced mutation
tttcctgtgtgcatcagagaggtgccaggtgctgaagggatatga

SEQ ID NO: 609 - DNA, 50 bp, Artificial Sequence
  synthetic wild-type (WT) Xenopus tropicalis grp78/bip TALEN binding region
tgccagcgtatttgctgctgatgatgatgacaagagggaagatgttggga

SEQ ID NO: 610 - DNA, 23 bp, Artificial Sequence
  synthetic Xenopus tropicalis grp78/bip TALEN induced mutation
tgacaagagggaagatgttggga

SEQ ID NO: 611 - DNA, 37 bp, Artificial Sequence
  synthetic Xenopus tropicalis grp78/bip TALEN induced mutation
tgccagcgtatttgctgctgatgggaagatgttggga

SEQ ID NO: 612 - DNA, 41 bp, Artificial Sequence
  synthetic Xenopus tropicalis grp78/bip TALEN induced mutation
tgccagcgtatttgctgctgacaagagggaagatgttggga

SEQ ID NO: 613 - DNA, 44 bp, Artificial Sequence
  synthetic Xenopus tropicalis grp78/bip TALEN induced mutation
tgccagcgtatttgctgctgatgacaagagggaagatgttggga

SEQ ID NO: 614 - DNA, 47 bp, Artificial Sequence
  synthetic Xenopus tropicalis grp78/bip TALEN induced mutation
tgccagcgtatttgctgctgatgatgacaagagggaagatgttggga

SEQ ID NO: 615 - DNA, 50 bp, Artificial Sequence
  synthetic Xenopus tropicalis grp78/bip TALEN induced mutation
tgccagcgtatttgctgctgatgactccaagggaagatgacaagagggaa

SEQ ID NO: 616 - DNA, 912 bp, Artificial Sequence
  synthetic Xenopus tropicalis hhex TALEN-targeted sequence
acatgaaaacctgtgtttttgtaacatcaatgtgtcatctgaccggcaatgcaacagatgagtgaacagcttattgggtttctagtactgattgtacagttcattcaaaactgttaactgacttttctattttagagccaaatggaggcgtctcaagcaggaaaacccacagggaaataagaaagacgaaactgaaagtctagagaatatctgcgaagagagtcaggagaggtgtttgagtgctgagcagaagagcagagagtcctccttggatgaacccacctcatcgcccacctcccaagagactctggattcagaggtgtccgatgattccgaccaggaggtggacattgaaggagacaaaggattttacaactgtgcacattaactgctgctcagtaagaatggacctctcttcagcttgcactttaacagaagctggacctagctccctggtagcctgacttgggttaagccagtggctgtcggactttctcagttcaagcccccactggagttccaacctttgttcagggccccctcagctcataacaaggaaagcagcggtgtaccagtcagagcagaaaatacatttttatcccaaatcttatcctaattaaccttcaagttggaggtatctaggagagcaagtaggcattctcctcaaatttcattctttattgacctttcaggtgtatttaggagagcaaataggcatcctccctaattctcaccctaactggcaagcttctatcccacagtggcacagtttgggaaccactgagttaaggggatggaaaggacattttatcagtgtatatcaaggtttagtttgatcatggtcaaagttctatttcagattgtgtatttatcataaacggtgttactgtaatattttgcctaattgcacaa

SEQ ID NO: 617 - DNA, 859 bp, Artificial Sequence
  synthetic Xenopus tropicalis vpp1 TALEN-targeted sequence
aaactctgcccattatactggcatttgaagggttaatatataccaagcacagtacaagtacatattgtacttagtctggtcctaaacgctgcccattggtagggatgtagtactgcagaatggccatcaggtgtcgctgctttagctctctgcacaatagaaatagaatgtgatatcaaagctgtaatttgccaattgaattacttcggtgccagtattaatttaactattataatcaatgcatcaaattaagttgtcttcagtccccgccccccaacgggagccaatgggtgtcttaacaagcaggattcctttaggagatcgcgttggtcacattctctggcacccattggcccctaataataaaaataataaaggggtacagcccttaaattgtgatgtcattgtctatagtaatccctgacgtattatctcattgcagaaatgatgtcagcagtacggagctcctccttcagatgggctgggccacagaccacacccatattccttgggctcctcctccttcagtcttggccttcaggataaacttcatgcccctacagcaaactgggggaagaggatgagagtgggacatccccgctgagaatgctgggtaactggctgagggactgtcacatggtgtcaatgacacaggggattggctgccggtgccaccccacaatctgtatatactgtatatagtgtatatcctccccattccccatatccccttacacactcacttctttatttagtttttattatcagcaataaatctgctcaattggtttgatttatattttggtgcttagttctacttattcatcagcaagaaacagaaccgtgttatgtgtgtgca

SEQ ID NO: 618 - DNA, 743 bp, Artificial Sequence
  synthetic Xenopus tropicalis sox9 TALEN-targeted sequence
ctcaactctcttcgccaactttctctccattctcttcgcaccgttttgcgcatgaatctcttggatcccttcatgaagatgacagaagagcaagataagtgcatgtccggggcccccagcccaacaatgtccgaggactcggctggctccccatgcccctccggctctggctccgacacggagaacaccagaccccaagagaacactttccccaaaggggacccggagctgaagaaggagacagaggacgaaaagtttcctgtgtgcatcagagaggcggtcagccaggtgctgaagggatatgactggaccctggtaccgatgccagtcagagttaatggatccagcaagagcaagcctcatgtcaagagacccatgaacgccttcatggtgtgggcacaggctgcaaggaggaagctggccgaccaatacccccatctgcacaatgcagaactcagcaagactctgggcaagttatggaggtaagtggccacctctgtgagcttggggttgaaggtgttaacatgcatgtaacctcttttcatatggtgggaaattggggaggagttggttttgatgcaaaatgtggttattgctgtgcgcctctgtattgcgcagctgtattggcactttgcgctttgtgcgcgtctgtaactctcttgcctgtctgctggcggctcccttggcactgtattccaggcttgccagggatgtgctgtaggtctgtatcggtacagccaaga

SEQ ID NO: 619 - DNA, 583 bp, Artificial Sequence
  synthetic Xenopus tropicalis foxd3 TALEN-targeted sequence
gagcggcatctgtgagttcatcagcaaccgcttcccctactatcgggagaagttcccggcctggcagaactccatccgccacaatctctcgcttaatgactgcttcgtcaaaatcccccgggagcccggaaacccaggcaagggaaactactggaccctggacccccagtccgaggacatgttcgacaatggcagtttcctcaggagaaggaagcgctttaagagacaacagccggactcattgagggagcagacggctctcatgatgcaaagctttggggcttacagcctggccggtccctatgggcgcccctatgggctccaccctgcagcctacactcaccctgctgccctgcagtatccttacatccccccggtggggcccatgttacccccggcggtgccacttctgccttcctctgaactgagcaggaaagccttcagctcgcagctcagccccagcctccagctgcagctcagcagcctcagcagtaccgcagcctccatcattaagtctgagcccagcagccgaccctccttcagcatagagaacattattggggtatcggcagcctcctcgata

SEQ ID NO: 620 - DNA, 928 bp, Artificial Sequence
  synthetic Xenopus tropicalis grp78/bip TALEN-targeted sequence
aaaccctattgaattagttggaggcatatgaattttgtgcatgttgggatatgcggcagcttgtctgctgaataatgggcagagtgctgcctctagaatgttctttcccaccgcccatgtctgaatcagcgtgtttccccattggctgctgagaagggctccctttaaagacgcctcccatccatggctcggcctactattatcccccttgtatcgtgctagagtggagctggtaactgttttactgccagagtggaataaccacacatacgctgcttaataccttatgctactgctttggtgttaaaagcatcttttatatatttcatttgtctttttatagtgtggtgcacaacttcatttcataactggttgtgacaaacaaatctcatggtgaccatgaagctgtttgccttggtgttgctggtgtctgccagcgtatttgctgctgatgatgatgacaagagggaagatgttgggactgtggttggaattgatttgggaacaacatattcctggtaagtagtcctcacagaaccaaaaaatgttttatttttattatcaaagctgggaaataagctaataagctaatggctcattggttttttctagtcggaatacttgagcacagacctgtgcatttttaataaatgtgctatttattagaaaatgttattctctgcagtgtttggacttaattaggcactgtggaggctataaaatctctggcctttgtgcccctatatataataataaccagttctcttatctgtctttgcaaatacaatgtggcattaaggaatctgtatttataacttcaggtagcaatgtacatcttcatagtacaataatagtatggacaggggaaatgacactgcaaagaatgtgaatttataattataatggtttggagtcacatgttaaggga

SEQ ID NO: 621 - DNA, 50 bp, Artificial Sequence; identical to SEQ ID NO: 486
  synthetic wild-type (WT) Xenopus tropicalis ptf1a/p48 TALEN binding region

SEQ ID NO: 622 - DNA, 26 bp, Artificial Sequence
  synthetic Xenopus tropicalis ptf1a/p48 TALEN induced mutation
ttcactgacccagacgactttttgga

SEQ ID NO: 623 - DNA, 34 bp, Artificial Sequence
  synthetic Xenopus tropicalis ptf1a/p48 TALEN induced mutation
ttcactgaccattccttccagacgactttttgga

SEQ ID NO: 624 - DNA, 37 bp, Artificial Sequence
  synthetic Xenopus tropicalis ptf1a/p48 TALEN induced mutation
ttcactgaccattcctggacccagacgactttttgga

SEQ ID NO: 625 - DNA, 39 bp, Artificial Sequence; identical to SEQ ID NO: 511
  synthetic Xenopus tropicalis ptf1a/p48 TALEN induced mutation

SEQ ID NO: 626 - DNA, 41 bp, Artificial Sequence
  synthetic Xenopus tropicalis ptf1a/p48 TALEN induced mutation
ttcactgaccattcctctacggacgcagacgaccttttgga

SEQ ID NO: 627 - DNA, 40 bp, Artificial Sequence
  synthetic Xenopus tropicalis ptf1a/p48 TALEN induced mutation
ttcactgaccattcctctagggcccagacgactttttgga

SEQ ID NO: 628 - DNA, 40 bp, Artificial Sequence; identical to SEQ ID NO: 513
  synthetic Xenopus tropicalis ptf1a/p48 TALEN induced mutation

SEQ ID NO: 629 - DNA, 41 bp, Artificial Sequence
  synthetic Xenopus tropicalis ptf1a/p48 TALEN induced mutation
ttcactgaccattcctctagggacccagacgactttttgga

SEQ ID NO: 630 - DNA, 44 bp, Artificial Sequence
  synthetic Xenopus tropicalis ptf1a/p48 TALEN induced mutation
ttcactgaccattcctctagggaggacccagacgactttttgga

SEQ ID NO: 631 - DNA, 45 bp, Artificial Sequence
  synthetic Xenopus tropicalis ptf1a/p48 TALEN induced mutation
ttcactgaccattcctctaggtctggacccagacgactttttgga

SEQ ID NO: 632 - DNA, 46 bp, Artificial Sequence; identical to SEQ ID NO: 515
  synthetic Xenopus tropicalis ptf1a/p48 TALEN induced mutation

SEQ ID NO: 633 - DNA, 47 bp, Artificial Sequence
  synthetic Xenopus tropicalis ptf1a/p48 TALEN induced mutation
ttcactgaccattcctctagggacctggacccagacgactttttgga

SEQ ID NO: 634 - DNA, 49 bp, Artificial Sequence; identical to SEQ ID NO: 516
  synthetic Xenopus tropicalis ptf1a/p48 TALEN induced mutation

SEQ ID NO: 635 - DNA, 50 bp, Artificial Sequence
  synthetic Xenopus tropicalis ptf1a/p48 TALEN induced mutation
attcctctagggacccagacctaggaggactctataggaaaccagacgac

SEQ ID NO: 636 - DNA, 50 bp, Artificial Sequence; identical to SEQ ID NO: 517
  synthetic wild-type (WT) Xenopus tropicalis ets1 TALEN binding region

SEQ ID NO: 637 - DNA, 25 bp, Artificial Sequence
  synthetic Xenopus tropicalis ets1 TALEN induced mutation
ttactctgaaaggagtggagcagca

SEQ ID NO: 638 - DNA, 36 bp, Artificial Sequence
  synthetic Xenopus tropicalis ets1 TALEN induced mutation
ttactctgaaagaagttctgtatgagcggagcagca

SEQ ID NO: 639 - DNA, 38 bp, Artificial Sequence
  synthetic Xenopus tropicalis ets1 TALEN induced mutation
ttactctgaaaggagtggaccttatgagcggagcagca

SEQ ID NO: 640 - DNA, 41 bp, Artificial Sequence
  synthetic Xenopus tropicalis ets1 TALEN induced mutation
ttactctgaaaggagtggagttctgtatgagcggagcagca

SEQ ID NO: 641 - DNA, 42 bp, Artificial Sequence
  synthetic Xenopus tropicalis ets1 TALEN induced mutation
ttactctgaaaggagtggactttctgtatgagcggagcagca

SEQ ID NO: 642 - DNA, 45 bp, Artificial Sequence
  synthetic Xenopus tropicalis ets1 TALEN induced mutation
ttactctgaaaggagtgaaaggagttctgtatgagcggagcagca

SEQ ID NO: 643 - DNA, 47 bp, Artificial Sequence
  synthetic Xenopus tropicalis ets1 TALEN induced mutation
ttactctgaaaggagtggactttcagttctgtatgagcggagcagca

SEQ ID NO: 644 - DNA, 50 bp, Artificial Sequence
  synthetic Xenopus tropicalis ets1 TALEN induced mutation
ttactctgaaaggagtggactttctgtatgagaagttctgtatgagcgga

SEQ ID NO: 645 - DNA, 35 bp, Artificial Sequence
  synthetic Xenopus tropicalis ptf1a/p48 TALEN induced mutation
ttcactgaccattcctctagggacgactttttgga

SEQ ID NO: 646 - DNA, 39 bp, Artificial Sequence; identical to SEQ ID NO: 511
  synthetic Xenopus tropicalis ptf1a/p48 TALEN induced mutation

SEQ ID NO: 647 - DNA, 40 bp, Artificial Sequence; identical to SEQ ID NO: 512
  synthetic Xenopus tropicalis ptf1a/p48 TALEN induced mutation

SEQ ID NO: 648 - DNA, 41 bp, Artificial Sequence; identical to SEQ ID NO: 629
  synthetic zebrafish MiR-17-92N1 TALEN induced mutation

SEQ ID NO: 649 - protein, 7 aa, Artificial Sequence
  synthetic SV40 nuclear localization signal (NLS)
PKKKRKV

SEQ ID NO: 650 - protein, 5 aa, Artificial Sequence
  synthetic yeast Matalpha2 non-classical nuclear localization signal (NLS)
KIPIK

SEQ ID NO: 651 - DNA, 20 bp, Artificial Sequence
  synthetic subcloning sequence covering region from amino acid 153 in N-terminal domain to amino acid 63 in C-terminal domain
gtggatctacgcacgctcgg

SEQ ID NO: 652 - DNA, 20 bp, Artificial Sequence
  synthetic subcloning sequence covering region from amino acid 153 in N-terminal domain to amino acid 63 in C-terminal domain
gcacgtcccatcgcgttgcc

SEQ ID NO: 653 - DNA, 20 bp, Artificial Sequence
  synthetic PCR primer pCR8 F1
ttgatgcctggcagttccct

SEQ ID NO: 654 - DNA, 20 bp, Artificial Sequence
  synthetic PCR primer pCR8 R1
cgaaccgaacaggcttatgt

SEQ ID NO: 655 - DNA, 18 bp, Artificial Sequence
  synthetic PCR primer NTalF
gatgacaagggtaccgtg

SEQ ID NO: 656 - DNA, 19 bp, Artificial Sequence
  synthetic PCR primer CTalR
ctagttgggatccggcaac

SEQ ID NO: 657 - DNA, 23 bp, Artificial Sequence
  synthetic PCR primer Gria3aF
gtctgttcatgcgctccacggtc

SEQ ID NO: 658 - DNA, 22 bp, Artificial Sequence
  synthetic PCR primer Gria3aR
cttttcaataccgcaatgagtc

SEQ ID NO: 659 - DNA, 17 bp, Artificial Sequence
  synthetic PCR primer Gria3aR1
acaggcgtgcgtgactg

SEQ ID NO: 660 - DNA, 22 bp, Artificial Sequence
  synthetic PCR primer TnikbF
catctaatgactgcagaatcag

SEQ ID NO: 661 - DNA, 22 bp, Artificial Sequence
  synthetic PCR primer TnikbR
gaactaaactagctacatccag

SEQ ID NO: 662 - DNA, 23 bp, Artificial Sequence
  synthetic PCR primer Kiss1rF
gatatgcacacctcacatcacac

SEQ ID NO: 663 - DNA, 23 bp, Artificial Sequence
  synthetic PCR primer Kiss1rR
gtgatctgggttccctgtaccac

SEQ ID NO: 664 - DNA, 23 bp, Artificial Sequence
  synthetic PCR primer Kiss2rF
gatgctgcagagcacatcatgtg

SEQ ID NO: 665 - DNA, 22 bp, Artificial Sequence
  synthetic PCR primer Kiss2rR
ctgacttctactgtatatacag

SEQ ID NO: 666 - DNA, 23 bp, Artificial Sequence
  synthetic PCR primer Kiss1F
gaactcttctctttctgaaacac

SEQ ID NO: 667 - DNA, 22 bp, Artificial Sequence
  synthetic PCR primer Kiss1R
ccagtgacagctcacgtacagc

SEQ ID NO: 668 - DNA, 23 bp, Artificial Sequence
  synthetic PCR primer Kiss2F
gttcactgaagagagctcagttg

SEQ ID NO: 669 - DNA, 22 bp, Artificial Sequence
  synthetic PCR primer Kiss2R
ctggcataggctctggtgtgtc

SEQ ID NO: 670 - DNA, 22 bp, Artificial Sequence
  synthetic PCR primer SpexinF
aggactcttgcggcgtacgcac

SEQ ID NO: 671 - DNA, 22 bp, Artificial Sequence
  synthetic PCR primer SpexinR
gcataataggctataccataac

SEQ ID NO: 672 - DNA, 23 bp, Artificial Sequence
  synthetic PCR primer GnRH3F
cacatattatagcgaaactgcac

SEQ ID NO: 673 - DNA, 21 bp, Artificial Sequence
  synthetic PCR primer GnRH3R
tctcaccctgaatgttgcctc

SEQ ID NO: 674 - DNA, 23 bp, Artificial Sequence
  synthetic PCR primer MiR-214F
ctagtaacattatctttatcctc

SEQ ID NO: 675 - DNA, 21 bp, Artificial Sequence
  synthetic PCR primer MiR-214R
caccgcagagagcctatcctg

SEQ ID NO: 676 - DNA, 22 bp, Artificial Sequence
  synthetic PCR primer MiR-451F
ctctctagacaggatatcatcg

SEQ ID NO: 677 - DNA, 23 bp, Artificial Sequence
  synthetic PCR primer MiR-451R
gttcttcgttctcttacatccag

SEQ ID NO: 678 - DNA, 22 bp, Artificial Sequence
  synthetic PCR primer MiR-1-1F
gtctaaatgctcatatctgagg

SEQ ID NO: 679 - DNA, 21 bp, Artificial Sequence
  synthetic PCR primer MiR-1-1R
catcaggcctgcgcatcacac

SEQ ID NO: 680 - DNA, 21 bp, Artificial Sequence
  synthetic PCR primer MiR-1-2F
ctaatccactgcattgtgcag

SEQ ID NO: 681 - DNA, 23 bp, Artificial Sequence
  synthetic PCR primer MiR-1-2R
gtggactgctggtgaagttactg

SEQ ID NO: 682 - DNA, 22 bp, Artificial Sequence
  synthetic PCR primer MiR-17-92N12F
gtgacatgtgctttgccatgag

SEQ ID NO: 683 - DNA, 23 bp, Artificial Sequence
  synthetic PCR primer MiR-17-92N12R
gttgggtgtcttgccgaaggatg

SEQ ID NO: 684 - DNA, 24 bp, Artificial Sequence
  synthetic PCR primer Mir-17-92C12F
gtaaaggattgtggagattgtacc

SEQ ID NO: 685 - DNA, 25 bp, Artificial Sequence
  synthetic PCR primer MiR-17-92C12R
gacaaaacttcagcagtgaacacag

SEQ ID NO: 686 - DNA, 22 bp, Artificial Sequence
  synthetic PCR primer MiR-17-92F
gtacacatgcttaatgcagagg

SEQ ID NO: 687 - DNA, 22 bp, Artificial Sequence
  synthetic PCR primer MiR-430N12F
gtcaggtaggtcttacgcacac

SEQ ID NO: 688 - DNA, 24 bp, Artificial Sequence
  synthetic PCR primer MiR-430N12R
cacatattgatcattactgctaac

SEQ ID NO: 689 - DNA, 22 bp, Artificial Sequence
  synthetic PCR primer MiR-430C1F
ctgacagcaacgggaacagatg

SEQ ID NO: 690 - DNA, 23 bp, Artificial Sequence
  synthetic PCR primer MiR-430C1R
aacgatgcagagacaagaccctg

SEQ ID NO: 691 - DNA, 22 bp, Artificial Sequence
  synthetic PCR primer MiR-430C2F
gtcccgatagactctgctagag

SEQ ID NO: 692 - DNA, 24 bp, Artificial Sequence
  synthetic PCR primer MiR-430C2R
ctcgcagattggaatctatccttc

SEQ ID NO: 693 - DNA, 49 bp, Artificial Sequence
  synthetic zebrafish Gria3 TALEN target site
tcgtccaatagcttctcagtcacgcacgcctgtgagtttctgctcttta

SEQ ID NO: 694 - DNA, 48 bp, Artificial Sequence
  synthetic zebrafish Tnikb TALEN target site
tgttattttctcccctaaggatcctgcgggcatttttgagctggtgga

SEQ ID NO: 695 - DNA, 50 bp, Artificial Sequence
  synthetic zebrafish Kiss1r TALEN target site
ttcatgtgcaaatttgttgcttttcttcaacaggtaataatagaacctca

SEQ ID NO: 696 - DNA, 57 bp, Artificial Sequence
  synthetic zebrafish Kiss2r TALEN target site
taacctaatagtcatctatgtggtcattaaaaaccagcagatgaagacggttacaaa

SEQ ID NO: 697 - DNA, 51 bp, Artificial Sequence
  synthetic zebrafish Kiss1 TALEN target site
tacacacaaacccctctgggcattttcagtattacttagaaggtaagttca

SEQ ID NO: 698 - DNA, 53 bp, Artificial Sequence
  synthetic zebrafish Kiss2 TALEN target site
tgattctcttcatgtctgcaatggtcagtcagtctacagctatgagagcaata

SEQ ID NO: 699 - DNA, 57 bp, Artificial Sequence
  synthetic zebrafish GnRH3 TALEN target site
tgttttagttttagcatggagtggaaaggaaggttgctggtccagttgttgctgtta

SEQ ID NO: 700 - DNA, 49 bp, Artificial Sequence
  synthetic zebrafish Spexin TALEN target site
tttgtgtcccattcctggagcgcacccaaggtaatgtcatgcaatgtta

SEQ ID NO: 701 - DNA, 52 bp, Artificial Sequence
  synthetic zebrafish MiR-214 TALEN target site
tgcagaacttcctgcacctgtacagcaggcacagacaggcagacagatggca

SEQ ID NO: 702 - DNA, 56 bp, Artificial Sequence
  synthetic zebrafish MiR-451 TALEN target site
tcgctgtgacagagagaggcggcgaaaccgttaccattactgagtttagtaatgga

SEQ ID NO: 703 - DNA, 49 bp, Artificial Sequence
  synthetic zebrafish MiR-1-1 TALEN target site
tatgaacaagagcagctatggaatgtaaagaagtatgtatcccaggtga

SEQ ID NO: 704 - DNA, 50 bp, Artificial Sequence
  synthetic zebrafish MiR-1-2 TALEN target site
tatgaacatataaaagctatggaatgtaaagaagtatgtattcttggtca

SEQ ID NO: 705 - DNA, 21 bp, Artificial Sequence
  synthetic colony PCR primer P1 for Xenopus tropicalis noggin TALEN targeted site
ggtgatcgagctgaaagtgaa

SEQ ID NO: 706 - DNA, 21 bp, Artificial Sequence
  synthetic colony PCR primer P2 for Xenopus tropicalis noggin TALEN targeted site
gtgaaaacctaccactggtgg

SEQ ID NO: 707 - DNA, 24 bp, Artificial Sequence
  synthetic colony PCR primer P3 for Xenopus tropicalis noggin TALEN targeted site
cttttgcattagtccaagagtctc

SEQ ID NO: 708 - DNA, 21 bp, Artificial Sequence
  synthetic colony PCR primer P2 for Xenopus tropicalis noggin ZFN targeted site
tattgagcatccggatcctat

SEQ ID NO: 709 - DNA, 19 bp, Artificial Sequence
  synthetic colony PCR primer P1 for Xenopus tropicalis p48 TALEN targeted site
gcagaagcgcaatgctatg

SEQ ID NO: 710 - DNA, 20 bp, Artificial Sequence
  synthetic colony PCR primer P2 for Xenopus tropicalis p48 TALEN targeted site
gaccattcctctagggacgc

SEQ ID NO: 711 - DNA, 21 bp, Artificial Sequence
  synthetic colony PCR primer P3 for Xenopus tropicalis p48 TALEN targeted site
gtgtctaccttggacagtcgc

SEQ ID NO: 712 - DNA, 19 bp, Artificial Sequence
  synthetic colony PCR primer P2 for Xenopus tropicalis p48 ZFN targeted site
tggagtccttcccttcccc

SEQ ID NO: 713 - DNA, 24 bp, Artificial Sequence
  synthetic colony PCR primer Pre P1 for Xenopus tropicalis ets1 TALEN targeted site
ggttcgtgtttggatacaagtacc

SEQ ID NO: 714 - DNA, 22 bp, Artificial Sequence
  synthetic colony PCR primer Pre P3 for Xenopus tropicalis ets1 TALEN targeted site
aaaagtatgttcaacccaagcc

SEQ ID NO: 715 - DNA, 19 bp, Artificial Sequence
  synthetic colony PCR primer P1 for Xenopus tropicalis ets1 TALEN targeted site
tccccgagaatggacagac

SEQ ID NO: 716 - DNA, 23 bp, Artificial Sequence
  synthetic colony PCR primer P2 for Xenopus tropicalis ets1 TALEN targeted site
ctctgaaaggagtggactttcag

SEQ ID NO: 717 - DNA, 24 bp, Artificial Sequence
  synthetic colony PCR primer P3 for Xenopus tropicalis ets1 TALEN targeted site
ctttctgtaagatctccaagtgct

SEQ ID NO: 718 - DNA, 19 bp, Artificial Sequence
  synthetic colony PCR primer P1 for Xenopus laevis ets1a TALEN targeted site
tccccgagaatggacagac

SEQ ID NO: 719 - DNA, 23 bp, Artificial Sequence
  synthetic colony PCR primer P2 for Xenopus laevis ets1a TALEN targeted site
ctctgaaaggagtggactttcag

SEQ ID NO: 720 - DNA, 22 bp, Artificial Sequence
  synthetic colony PCR primer P3 for Xenopus laevis ets1a TALEN targeted site
ctttctgcaagatctccaagtg

SEQ ID NO: 721 - DNA, 25 bp, Artificial Sequence
  synthetic colony PCR primer P1 for Xenopus tropicalis hex TALEN targeted site
acatgaaaacctgtgtttttgtaac

SEQ ID NO: 722 - DNA, 22 bp, Artificial Sequence
  synthetic colony PCR primer P2 for Xenopus tropicalis hex TALEN targeted site
caactgtgcacattaactgctg

SEQ ID NO: 723 - DNA, 24 bp, Artificial Sequence
  synthetic colony PCR primer P3 for Xenopus tropicalis hex TALEN targeted site
ttgtgcaattaggcaaaatattac

SEQ ID NO: 724 - DNA, 22 bp, Artificial Sequence
  synthetic colony PCR primer P1 for Xenopus tropicalis vpp1 TALEN targeted site
aaactctgcccattatactggc

SEQ ID NO: 725 - DNA, 22 bp, Artificial Sequence
  synthetic colony PCR primer P2 for Xenopus tropicalis vpp1 TALEN targeted site
cttggccttcaggataaacttc

SEQ ID NO: 726 - DNA, 21 bp, Artificial Sequence
  synthetic colony PCR primer P3 for Xenopus tropicalis vpp1 TALEN targeted site
tgcacacacataacacggttc

SEQ ID NO: 727 - DNA, 24 bp, Artificial Sequence
  synthetic colony PCR primer P1 for Xenopus tropicalis sox9 TALEN targeted site
ctcaactctcttcgccaactttct

SEQ ID NO: 728 - DNA, 20 bp, Artificial Sequence
  synthetic colony PCR primer P2 for Xenopus tropicalis sox9 TALEN targeted site
tgcatcagagaggcggtcag

SEQ ID NO: 729 - DNA, 23 bp, Artificial Sequence
  synthetic colony PCR primer P3 for Xenopus tropicalis sox9 TALEN targeted site
tcttggctgtaccgatacagacc

SEQ ID NO: 730 - DNA, 22 bp, Artificial Sequence
  synthetic colony PCR primer P1 for Xenopus tropicalis foxd3 TALEN targeted site
gagcggcatctgtgagttcatc

SEQ ID NO: 731 - DNA, 22 bp, Artificial Sequence
  synthetic colony PCR primer P2 for Xenopus tropicalis foxd3 TALEN targeted site
gacaatggcagtttcctcagga

SEQ ID NO: 732 - DNA, 21 bp, Artificial Sequence
  synthetic colony PCR primer P3 for Xenopus tropicalis foxd3 TALEN targeted site
tatcgaggaggctgccgatac

SEQ ID NO: 733 - DNA, 25 bp, Artificial Sequence
  synthetic colony PCR primer P1 for Xenopus tropicalis bip TALEN targeted site
aaaccctattgaattagttggaggc

SEQ ID NO: 734 - DNA, 23 bp, Artificial Sequence
  synthetic colony PCR primer P2 for Xenopus tropicalis bip TALEN targeted site
gcgtatttgctgctgatgatgat

SEQ ID NO: 735 - DNA, 24 bp, Artificial Sequence
  synthetic colony PCR primer P3 for Xenopus tropicalis bip TALEN targeted site
tcccttaacatgtgactccaaacc

SEQ ID NO: 736 - DNA, 27 bp, Artificial Sequence
  synthetic colony PCR primer Fw for Xenopus tropicalis noggin287 mismatch off-target site
cgccaattggacatcactgctatatag

SEQ ID NO: 737 - DNA, 28 bp, Artificial Sequence
  synthetic colony PCR primer Re for Xenopus tropicalis noggin287 mismatch off-target site
cgttacatctggcgtaaaagtaacacag

SEQ ID NO: 738 - DNA, 25 bp, Artificial Sequence
  synthetic colony PCR primer Fw for Xenopus tropicalis ets152 mismatch off-target site
ccctaaaacacaaacatcgtagggc

SEQ ID NO: 739 - DNA, 25 bp, Artificial Sequence
  synthetic colony PCR primer Re for Xenopus tropicalis ets152 mismatch off-target site
gtccctttccttccttggaggatac

What is claimed is:

1. A polynucleotide sequence encoding a transcription activator like effector nuclease (TALEN), the TALEN comprising from an N-terminus to a C-terminus:
   (i) a first segment of about 50 to about 200 amino acids in length, wherein the first segment comprises the amino acid sequence of SEQ ID NO: 1;
   (ii) a TAL effector DNA-binding domain providing sequence-specific binding to a target nucleotide sequence, wherein the TAL effector DNA-binding domain comprises 12-31 TAL repeats and a C-terminal truncated TAL repeat;
   (iii) a second segment of about 20 to 100 amino acids in length, wherein the first segment comprises the amino acid sequence of SEQ ID NO: 2; and
   (iv) a modified FokI nuclease catalytic domain.

2. The polynucleotide sequence of claim 1, wherein the polynucleotide is mRNA.

3. An expression cassette comprising a promoter and further comprising the polynucleotide of claim 1.

4. The expression cassette of claim 3, further comprising a coding sequence for a nuclear localization signal (NLS) and a polyadenylation signal sequence.

5. The expression cassette of claim 4, wherein the NLS comprises an SV40 NLS.

6. The expression cassette of claim 5, wherein the SV40 NLS comprises PKKKRKV (SEQ ID NO:649).

7. The expression cassette of claim 4, wherein the expression cassette is the plasmid pCS2-TALENs-ELD or pCS2-TALENs-KKR.

8. A host cell comprising the expression cassette of claim 3.

9. A method of producing the mRNA of claim 2, comprising providing a polynucleotide sequence of claim 1, wherein the polynucleotide sequence is DNA, under conditions permissible for mRNA transcription.

10. The polynucleotide of claim 1, wherein the modified FokI nuclease catalytic domain is an obligate heterodimer.

11. The polynucleotide of claim 1, wherein the modified FokI nuclease catalytic domain has the amino acid sequence of SEQ ID NOs:3 or 4.

* * * * *